(12) United States Patent
Dixon et al.

US009969991B2

(10) Patent No.: US 9,969,991 B2
(45) Date of Patent: *May 15, 2018

(54) INTERNAL PROTEIN TAGS

(71) Applicant: Promega Corporation, Madison, WI (US)

(72) Inventors: Andrew S. Dixon, Verona, WI (US);
Lance P. Encell, Fitchburg, WI (US);
Thomas Machleidt, Madison, WI (US);
Marie Schwinn, Madison, WI (US);
Keith Wood, Mt. Horeb, WI (US);
Monika Wood, Mt. Horeb, WI (US);
Kris Zimmerman, Madison, WI (US)

(73) Assignee: Promega Corporation, Madison, WI (US)

( * ) Notice: Subject to any disclaimer, the term of this patent is extended or adjusted under 35 U.S.C. 154(b) by 0 days. days.

This patent is subject to a terminal disclaimer.

(21) Appl. No.: 14/852,096

(22) Filed: Sep. 11, 2015

(65) Prior Publication Data

US 2016/0097042 A1    Apr. 7, 2016

Related U.S. Application Data

(60) Provisional application No. 62/049,875, filed on Sep. 12, 2014.

(51) Int. Cl.
*C12Q 1/34* (2006.01)
*C12N 9/14* (2006.01)
*C07K 14/00* (2006.01)
*C07K 14/47* (2006.01)

(52) U.S. Cl.
CPC .............. *C12N 9/14* (2013.01); *C07K 14/00* (2013.01); *C07K 14/47* (2013.01); *C07K 2319/60* (2013.01); *C07K 2319/70* (2013.01); *C12Y 308/01005* (2013.01)

(58) Field of Classification Search
CPC .................................. C12N 9/14; C07K 14/00
USPC ...................................................... 435/18, 188
See application file for complete search history.

(56) References Cited

U.S. PATENT DOCUMENTS

| 8,557,970 | B2 | 10/2013 | Encell et al. |
| 8,669,103 | B2 | 3/2014 | Binkowski et al. |
| 2010/0281552 | A1 | 11/2010 | Encell et al. |
| 2014/0120548 | A1 | 5/2014 | Encell et al. |
| 2014/0194307 | A1 | 7/2014 | Hitko et al. |
| 2014/0223590 | A1 | 8/2014 | Binkowski et al. |
| 2014/0227759 | A1 | 8/2014 | Binkowski et al. |
| 2014/0348747 | A1 | 11/2014 | Dixon et al. |
| 2016/0097042 | A1* | 4/2016 | Dixon ..................... C12N 9/14 435/18 |

FOREIGN PATENT DOCUMENTS

WO     WO 2016/040835     3/2016

OTHER PUBLICATIONS

Brown et al., Facile approach for constructing TEV insertions to probe protein structure in vivo. Biotechniques. Dec. 2006;41(6):721-4.
International Search Report and Written Opinion for PCT/US2015/049741, dated Jan. 28, 2016, 17 pages.

* cited by examiner

*Primary Examiner* — Tekchand Saidha
(74) *Attorney, Agent, or Firm* — Casimir Jones SC; David W. Staple

(57) ABSTRACT

Provided herein are substantially non-luminescent peptide/polypeptide tags that are inserted internally within a protein of interest or between N-terminal and C-terminal peptides/polypeptides. Interaction of the internally-inserted tag with a complement polypeptide/peptide that is also substantially non-luminescent results in the formation a bioluminescent reporter complex.

16 Claims, 18 Drawing Sheets

FIG. 7

Target with terminal small Bit
ATG1915

Targets with an internal small Bit
Small Bit between two large domains
ATG1917

Small Bit between a large domain and a peptide
ATG1946

GSSG-[VTGYRLFEEIL]K[VTGYRLFEEIL]-GSSG

INTERNAL PROTEIN TAGS

CROSS-REFERENCE TO RELATED APPLICATION

The present application claims priority to U.S. Provisional Patent Application Ser. No. 62/049,875 filed Sep. 12, 2014, which is hereby incorporated by reference in its entirety.

FIELD

Provided herein are substantially non-luminescent peptide/polypeptide tags that are inserted internally within a protein of interest or between N-terminal and C-terminal peptides/polypeptides. Interaction of the internally-inserted tag with a complement polypeptide/peptide results in the formation a bioluminescent reporter complex.

BACKGROUND

Tagging of proteins with reporters or affinity tags is commonly used to analyze protein function and behavior. In general, genetic fusions are generated using either the C- or N-terminus of the protein of interest.

SUMMARY

Provided herein are substantially non-luminescent peptide/polypeptide tags that are inserted internally within a protein of interest or between N-terminal and C-terminal peptides/polypeptides. Interaction of the internally-inserted tag with a complement polypeptide/peptide results in the formation of a bioluminescent reporter complex.

In some embodiments provided herein are compositions, systems, methods etc. comprising a protein or polypeptide with an internal tag inserted therein. In some embodiments provided herein are compositions, systems, methods etc. comprising an internal tag inserted between C-terminal and N-terminal peptides/polypeptides. In certain embodiments, a structural complement sequence (or the internal tag) is also provided (e.g., free or as a fusion (e.g., internal or terminal)). In some embodiments, both the internal tag and the structural complement are substantially inactive (e.g., lacking enzymatic activity (e.g., substantially non-luminescent, etc.)). In some embodiments, the internal tag and the structural complement have high affinity for each other and form a complex (e.g., stable complex) when in solution together. In other embodiments, the internal tag and the structural complement have low affinity for each other and do not form a complex (e.g., stable complex) unless brought together by external factors/forces (e.g., interaction elements fused to the internal tag and structural complement). In some embodiments, a complex of the internal tag and the structural complement produces a detectable activity (e.g., luminescence in the presence of substrate).

In some embodiments, an internal fusion is provided. In some embodiments, an internal tag sequence (e.g., one that produces detectable activity when complexed with a structural complement) resides internally within the sequence of a protein or polypeptide sequence of interest. In some embodiments, an internal tag resides within the protein or polypeptide sequence of interest at a location that maintains: (i) the ability of the internal tag to form an active complex with a structural complement, and (ii) structural or activity characteristics of the protein or polypeptide of interest. In some embodiments, the structure or activity of one or more domains of interest of the protein or polypeptide of interest are uninterrupted by the presence of the internal tag within the sequence of the polypeptide or protein of interest. In some embodiments, the internal tag resides at a location within the protein of interest such that it is surface accessibly exposed on the surface of the protein of interest. In some embodiments, the internal tag resides at a loop of the protein of interest such that disruption to the structure and/or activity of the protein of interest is reduced/minimized.

In some embodiments, an internal tag sequence (e.g., one that produces detectable activity when complexed with a structural complement) resides internally between a C-terminal peptide/polypeptide and an N-terminal peptide/polypeptide. In some embodiments, an internal tag is linked to C-terminal and N-terminal peptides/polypeptides at locations that maintain: (i) the ability of the internal tag to form an active complex with a structural complement, and (ii) structural or activity characteristics of the C-terminal and N-terminal peptides/polypeptides.

In some embodiments, an internal tag and a complement peptide/polypeptide are fused to and/or inserted within separate domains of the same multi-domain protein. Upon folding of the protein, or a conformational change, activity from the complex of the internal tag and complement is detectable.

In some embodiments, methods of using an internal tag are provided. Some of the following embodiments are described for use with an internal tag and a protein of interest; however, whenever appropriate, they may also find use with an internal tag between N-terminal and C-terminal peptides/polypeptides.

In some embodiments, methods are provided for detecting the presence and/or location of a protein/polypeptide of interest using an internal tag and a structural complement that form an active complex upon association. In some embodiments, the presence and/or location in a sample (e.g., cell, subcellular location, in vitro sample, etc.) of a polypeptide with an internal tag is determined by adding a free structural complement having high affinity for the internal tag to the sample. Detection of the activity produced by complex formation indicates the presence and/or location of the protein/polypeptide of interest. In some embodiments, an active complex of an internal tag and a structural complement are detected in environments including, but not limited to: an in vitro sample, cell lysate, within living cells, within a living organism, etc.

In some embodiments, methods are provided for detecting interactions between a protein of interest and selected interaction partners (e.g., nucleic acids, peptides, proteins, polypeptides, small molecules, lipids, etc.) using an internal tag and a structural complement that form an active complex upon association. In some embodiments, the interaction of (i) a protein of interest with an internal tag and (ii) an interaction partner (e.g., nucleic acids, peptides, proteins, polypeptides, small molecules, lipids, etc.) linked to a structural complement having low affinity for the internal tag is detected upon formation of the active complex between the internal tag and the structural complement. In some embodiments, interactions are detected in environments including, but not limited to: an in vitro sample, cell lysate, within living cells, within a living organism, etc.

In some embodiments, methods are provided for detecting intramolecular interactions within a protein of interest by labeling the protein of interest with an internal tag and a complement peptide/polypeptide (internal or end-labeled with complement). A conformational change, folding, or other intramolecular interaction is detected by formation of a complex of the internal tag and the complement.

In some embodiments, the efficiency of complementation (and formation of an active complex and detectable luminescence) of an internal tag residing within a protein or polypeptide of interest and its structural complement is affected by one or more of: (i) conformational changes in the protein or polypeptide of interest (e.g., conformational changes that affect the accessibility of the internal tag to the structural complement), (ii) molecular interactions of the protein or polypeptide of interest (e.g., with a drug), and/or environmental changes (e.g., changes to conditions).

In some embodiments provided herein are compositions comprising a peptide and/or polypeptide tags that: (i) are not fragments of a preexisting protein, (ii) are substantially non-luminescent, (iii) are inserted internally within a protein of interest, and (iv) form a luminescent complex with a structurally complementary polypeptide and/or peptide. Also provided herein are luminescent complexes of the internal peptide and/or polypeptide tags with their complement polypeptide and/or peptide, and methods of generating an optically detectable bioluminescent signal upon formation of such complexes. In some embodiments provided herein are two or more substantially non-luminescent peptides and/or polypeptides, one or more of which are provided as internal protein tags that, when brought together, assemble into a bioluminescent complex. In some embodiments, a substantially non-luminescent peptide and/or polypeptide internal tag and its complement polypeptide/peptide assemble into a bioluminescent complex. In some embodiments, the complement peptide/polypeptide is also an internal tag. In other embodiments, the complement is a terminal (e.g., N-terminal of C-terminal) tag. In other embodiments, the complement is not associated with another peptide, polypeptide, or protein (e.g., free). In some embodiments, three or more substantially non-luminescent peptide and/or polypeptide units, one or more of which are internal protein tags assemble into a bioluminescent complex (e.g., ternary complex, tertiary complex, etc.). In some embodiments provided herein are technologies for detecting internally tagged proteins or polypeptides via the formation of a bioluminescent complex of the otherwise substantially non-luminescent internal tag and its substantially non-luminescent structural complement. In some embodiments, interactions between a protein of interest and another moiety (e.g., protein, peptide, nucleic acid, lipid, small molecule, etc.) are identified by detection of the formation of a bioluminescent complex between a substantially non-luminescent internal tag of the protein of interest and a substantially non-luminescent structural complement of the internal tag. In some embodiments, such compositions are provided in environments including, but not limited to: an in vitro sample, cell lysate, within living cells, within a living organism, etc.

In some embodiments, interactions between different regions of a protein, or domains of a multi-domain protein, are detected by labeling the different regions/domains with an internal tag and complement. Activity from the complex of the internal tag and complement indicates intra-protein interactions (e.g., conformational change, folding, etc.).

In some embodiments, the complex of a substantially non-luminescent internal tag and its substantially non-luminescent structural complement catalyzes a chemical reaction of an appropriate substrate into a high energy state, and light is emitted. In some embodiments, a bioluminescent complex of an internal protein tag and its structural complement exhibits luminescence in the presence of substrate (e.g., coelenterazine, furimazine, etc.).

Although the embodiments described herein primarily describe and refer to the formation of a luminescent complex (e.g., comprising at least one substantially non-luminescent tag and its substantially non-luminescent complement) complementary, it is noted that the present technology can equally be applied to other detectable attributes (e.g., other enzymatic activities, generation of a fluorophore, generation of a chromophore, etc.). The embodiments described herein relating to luminescence should be viewed as applying to internal tags that are substantially non-enzymatically active amino acid chains (e.g., peptides and/or polypeptides that are not fragments of a preexisting protein) and their structurally complementary polypeptide/peptide that also lack a specified detectable activity (e.g., enzymatic activity), and the enzymatically active complexes thereof. Provided herein are methods of generating a detectable activity (e.g., an enzymatic activity) upon association of a substantially non-enzymatically active, internal tag and its substantially non-enzymatically active complement peptide/polypeptide.

The invention is further directed to assays for the detection of molecular interactions (e.g., transient association, stable association, complex formation, etc.) between a protein (or polypeptide) of interest and another moiety (e.g., peptide, polypeptide, protein, nucleic acid, small molecule etc.) by inserting an internal tag into the protein of interest and tagging the other moiety (e.g., internally labeled, terminally labeled, etc.) with the structural complement of the internal tag, wherein no signal (e.g., substantially no signal) is produced in the absence of the molecular interaction between the protein of interest and the other moiety, but a detectable (e.g., bioluminescent) complex of the internal tag and its complement is produced upon interaction of the protein of interest and the other moiety. In such embodiments, assembly of the bioluminescent complex is operated by the molecular interaction of the protein of interest and the other moiety. If the protein of interest and the other moiety engage in a sufficiently stable interaction, the bioluminescent complex of the internal tag and its complement forms, and a bioluminescent signal is generated. If the protein of interest and the other moiety fail to engage in a sufficiently stable interaction, the bioluminescent complex does not form, or only weakly forms, and a bioluminescent signal is not generated or is substantially reduced (e.g., substantially undetectable, essentially not detectable, differentially detectable as compared to a stable control signal, etc.). In some embodiments, the magnitude of the detectable bioluminescent signal is proportional (e.g., directly proportional) to the amount, strength, favorability, and/or stability of the molecular interactions between the protein of interest and the other moiety.

In some embodiments, provided herein are internal tags comprising an amino acid sequence having less than 100% (e.g., 20% . . . 30% . . . 40% . . . 50% . . . 60% . . . 70% . . . 80%, 90% or more) sequence identity with SEQ ID NO: 2, wherein a detectable bioluminescent signal is produced when the peptide contacts a complement polypeptide of SEQ ID NO: 440. In some embodiments, provided herein are internal tags comprising an amino acid sequence having less than 100% and greater than 30% (e.g., >30%, >40%, >45%, >50%, >55%, >60%, >65%, >70%, >75%, >80%, >85%, >90%, >95%, >98%, >99%) sequence identity with SEQ ID NO: 2, wherein a detectable bioluminescent signal is produced when the peptide contacts a structurally complementary polypeptide of SEQ ID NO: 440. In some embodiments, a detectable bioluminescent signal is produced when the internal tag contacts a polypeptide having less than 100% and greater than 30% (e.g., >30%, >40%, >45%, >50%, >55%, >60%, >65%, >70%, >75%, >80%, >85%, >90%, >95%, >98%, >99%) sequence identity with SEQ ID NO: 440. In certain embodiments, the detectable bioluminescent signal is produced, or is substantially increased, when the internal tag associates with the polypeptide comprising or consisting of SEQ ID NO: 440, or a portion thereof. Although not limited to these sequences, the peptide amino acid sequence may be selected from amino acid sequences of SEQ ID NOS: 3-438 and 2162-2365. In some embodiments, polypeptides are provided that comprise an above described internal tag inserted into a protein or polypeptide of interest (e.g., not on the C- or N-terminus of the protein or polypeptide). In some embodiments, a structural complement of the internal tag is provided alone or as a tag (e.g., internal or terminal) of another moiety (e.g., protein, peptide, polypeptide, nucleic acid, lipid, small molecule, etc.). In certain embodiments, bioluminescent complexes are provided that comprise: (a) a first polypeptide having an internal tag (e.g., not located at the N- of C-terminus); and (b) a peptide or polypeptide comprising a structural complement of the internal tag; wherein, when associated, the internal tag and its structural complement emit a detectable bioluminescent signal in the present of an appropriate substrate. In some embodiments, the internal tag comprises an amino acid sequence having less than 100% and greater than 30% sequence identity with SEQ ID NO: 2 and a detectable bioluminescent signal is produced when the internal tag contacts a structurally complementary polypeptide of SEQ ID NO: 440 in the presence of substrate.

In some embodiments provided herein are internal tags comprising an amino acid sequence having less than 100% sequence identity with SEQ ID NO: 440, wherein a detectable bioluminescent signal is produced when the internal tag contacts a peptide of SEQ ID NO: 2 in the presence of substrate. In some embodiments, the present invention provides internal tags comprising an amino acid sequence having less than 100% and greater than 30% (e.g., >30%, >40%, >45%, >50%, >55%, >60%, >65%, >70%, >75%, >80%, >85%, >90%, >95%, >98%, >99%) sequence identity with SEQ ID NO: 440, wherein a detectable bioluminescent signal is produced when the internal tag contacts a peptide of SEQ ID NO: 2. In some embodiments, a detectable bioluminescent signal is produced when the internal tag contacts a peptide having less than 100% and greater than 30% (e.g., >30%, >40%, >45%, >50%, >55%, >60%, >65%, >70%, >75%, >80%, >85%, >90%, >95%, >98%, >99%) sequence identity with SEQ ID NO: 2. Although not limited to such sequences, the internal tag sequence may be selected from one of the amino acid sequences of SEQ ID NOS: 441-2156. In some embodiments, a detectable bioluminescent signal is produced when the internal tag associates with a peptide of SEQ ID NO: 2 in the presence of appropriate substrate. In certain embodiments, bioluminescent complexes are provided that comprise: (a) a first polypeptide having an internal tag (e.g., not located at the N- of C-terminus); and (b) a peptide or polypeptide comprising a structural complement of the internal tag; wherein, when associated, the internal tag and its structural complement emit a detectable bioluminescent signal in the present of an appropriate substrate. In some embodiments, the internal tag comprises an amino acid sequence having less than 100% and greater than 30% sequence identity with SEQ ID NO: 440 and a detectable bioluminescent signal is produced when the internal contacts a structurally complementary peptide of SEQ ID NO: 2 in the presence of substrate.

In some embodiments, provided herein are nucleic acids (e.g., DNA, RNA, etc.), oligonucleotides, vectors, etc., that code for any of the peptides, polypeptides (e.g., comprising internal tags, comprising terminal tags, etc.), proteins (e.g., comprising internal tags, comprising terminal tags, etc.), fusion proteins, etc., described herein. In some embodiments, a nucleic acid comprising or consisting of one of the nucleic acid sequences of SEQ ID NOS: 3-438 and 2162-2365 (e.g., coding peptide internal tags, coding for peptide structural complements) and/or SEQ ID NOS 441-2156 (e.g., coding polypeptide internal tags, coding for polypeptide structural complements) are provided. In some embodiments, other nucleic acid sequences coding for amino acid sequences of SEQ ID NOS: 3-438 and 2162-2365 and/or SEQ ID NOS 441-2156 are provided.

In certain embodiments provided herein are bioluminescent complexes comprising: (a) a first polypeptide having an internal (e.g., not at the N- or C-terminus) tag comprising an amino acid sequence having less than 100% sequence identity (e.g., <99%, <95%, <90%, <80%, <70%, <60%, <50%, etc.) with SEQ ID NO: 2; and (b) a second polypeptide comprising an amino acid sequence (e.g., internally or terminally) having less than 100% and greater than 30% (e.g., >30%, >40%, >45%, >50%, >55%, >60%, >65%, >70%, >75%, >80%, >85%, >90%, >95%, >98%, >99%) sequence identity with SEQ ID NO: 440, wherein the bioluminescent complex exhibits detectable bioluminescence in the presence of substrate. In certain embodiments, provided herein are bioluminescent complexes comprising: (a) a polypeptide comprising an internal tag comprising an amino acid sequence having less than 100% and greater than 30% (e.g., >30%, >40%, >45%, >50%, >55%, >60%, >65%, >70%, >75%, >80%, >85%, >90%, >95%, >98%, >99%) sequence identity with SEQ ID NO: 2; and (b) a polypeptide comprising an amino acid sequence having less than 100% and greater than 30% (e.g., >30%, >40%, >45%, >50%, >55%, >60%, >65%, >70%, >75%, >80%, >85%, >90%, >95%, >98%, >99%) sequence identity with SEQ ID NO: 440, wherein the bioluminescent complex exhibits detectable bioluminescence in the presence of substrate.

In various embodiments, bioluminescent complexes are provided that comprise: (a) a first amino acid sequence comprising an internal tag sequence that is not a fragment of a preexisting protein; and (b) a second amino acid sequence comprising an amino acid sequence that is not a fragment of a preexisting protein, wherein the bioluminescent complex exhibits detectable bioluminescence when the first amino acid sequence and the second amino acid sequence are associated.

In some embodiments, interacting polypeptides are provided, wherein the first polypeptide comprises an internal tag (e.g., an amino acid sequence inserted at a position within its sequence (e.g., not at the N- or C-terminus)), and wherein the second polypeptide comprises a structural complement tag (e.g., an internally- or terminally-located amino acid sequence that is structurally complementary to the internal tag). Upon interaction of the first and second polypeptides, the internal tag and the structural complement tag associate to form a bioluminescent complex. In some embodiments, interaction of the interacting polypeptides is assessed based on the bioluminescence of the bioluminescent complex. In certain embodiments, interactions (e.g., non-covalent interactions (e.g., hydrogen bonds, ionic bonds, van der Waals forces, hydrophobic interactions, etc.), covalent interactions (e.g., disulfide bonds), etc.) between the internal tag and the structural complement tag do not result in significant bioluminescent complex formation in the absence of the interacting polypeptides. In some embodiments, such a system exists (e.g., is expressed) within a cell.

In some embodiments provided herein are bioluminescent complexes comprising: (a) a first substantially non-luminescent element inserted within a polypeptide sequence; and (b) a second substantially non-luminescent element (e.g., free, attached to a polypeptide (e.g., internally or terminally) attached to a molecular entity (e.g., small molecule, etc.), etc.) wherein each non-luminescent element is not a fragment of a preexisting protein.

Various embodiments described herein provide methods of detecting an interaction between a first amino acid sequence and a second amino acid sequence comprising, for example, the steps of: (a) inserting an internal tag within the first amino acid sequence and attaching a complement sequence (e.g., internally or terminally) to the second amino acid sequence, wherein the internal tag and complement sequences are not fragments of a preexisting protein, wherein a complex of the internal tag and the complement sequence emits a detectable bioluminescent signal (e.g., substantially increased bioluminescence relative to the internal tag and the complement sequence separately), wherein the interactions (e.g., non-covalent) between the internal tag and complementary sequence are insufficient to form, or only weakly form, a complex in the absence of additional stabilizing and/or aggregating conditions, and wherein an interaction between the first amino acid sequence and the second amino acid sequence provides the additional stabilizing and/or aggregating forces to produce a complex of the internal tag and the complement sequence; (b) placing the tagged first and second amino acid sequences of step (a) in conditions to allow for interactions between the first amino acid sequence and the second amino acid sequence to occur; and (c) detecting the bioluminescent signal emitted by the complex of the internal tag and complement sequence in the presence of appropriate substrate, wherein detection of the bioluminescent signal indicates an interaction between the first amino acid sequence and the second amino acid sequence. In some embodiments, the first amino acid sequence and the internal tag comprise an internal fusion. In some embodiments, the second amino acid sequence and the complement sequence comprise an internal fusion or a traditional fusion. In some embodiments, the first internal fusion protein (e.g., comprising an internal tag) and the second fusion protein (e.g., comprising a complement sequence) further comprise linkers between the fused elements. In certain embodiments, the fusion proteins are expressed from nucleic acids encoding said fusion proteins. In some embodiments, a single vector comprises both fusion proteins. In other embodiments, first and second fusion proteins are expressed from separate vectors.

In some embodiments provided herein are polypeptides comprising an N-terminal segment, a C-terminal segment, and an internal tag, wherein the internal tag comprises an amino acid sequence having less than 100% and greater than 30% sequence identity with SEQ ID NO: 2 inserted within a protein of interest; wherein a detectable bioluminescent signal is produced in the presence of a coelenterazine substrate when the internal tag contacts a polypeptide of SEQ ID NO: 440. In some embodiments, both the N-terminal segment and the C-terminal segment are at least 20 amino acids in length. In some embodiments, the N-terminal segment and/or the C-terminal segment are at least 50 amino acids in length. In some embodiments, the internal tag exhibits enhancement of one or more traits compared to a peptide of SEQ ID NO: 2, wherein the traits are selected from: affinity for the polypeptide of SEQ ID NO: 440, expression, intracellular solubility, intracellular stability, and bioluminescent activity when combined with the polypeptide of SEQ ID NO: 440. In some embodiments, the internal tag is selected from the peptides of Table 1. In some embodiments, the N-terminal segment and the C-terminal segment, if directly linked in the absence of the internal tag, comprise the sequence of a first protein of interest. In some embodiments, a nucleic acid is provided comprising a sequence coding for the internally tagged polypeptide. In some embodiments, a bioluminescent complex is provided comprising: (a) the internally tagged polypeptide; and (b) a second polypeptide comprising a complement polypeptide having less than 100% and greater than 30% sequence identity with SEQ ID NO: 440. In some embodiments, the internal tag and the complement polypeptide have low affinity for each other. In some embodiments, the second polypeptide is a fusion with a second protein of interest. In some embodiments, the fusion is an internal fusion or a traditional fusion. In some embodiments, the second protein of interest has an affinity for all or a portion of the N-terminal segment and/or the C-terminal segment. In some embodiments, the affinity may be altered by a structural modification to the first or second protein (e.g., a post-translational modification), or both, or by interaction with a third molecule (e.g., a drug, a nucleic acid, a protein, etc.). In some embodiments, the second polypeptide is linked to a molecule of interest. In some embodiments, all or a portion of the N-terminal segment and/or the C-terminal segment has an affinity for the molecule of interest. In some embodiments, a bioluminescent complex further comprises a coelenterazine substrate (e.g., furimazine). In some embodiments, the internal tag and the complement polypeptide have high affinity for each other. In some embodiments, the second polypeptide is not a fusion polypeptide or linked to a molecule of interest. In some embodiments, the complement polypeptide is selected from the peptides of Table 2.

In some embodiments provided herein are polypeptides comprising an N-terminal segment, a C-terminal segment, and an internal tag, wherein the internal tag comprises an amino acid sequence having less than 100% and greater than 30% sequence identity with SEQ ID NO: 440 inserted within a protein of interest; wherein a detectable bioluminescent signal is produced in the presence of a substrate when the detection peptide contacts a polypeptide of SEQ ID NO: 2. In some embodiments, both the N-terminal segment and the C-terminal segment are at least 20 amino acids in length. In some embodiments, the N-terminal segment and/or the C-terminal segment are at least 50 amino acids in length. In some embodiments, the internal tag exhibits enhancement of one or more traits compared to a peptide of SEQ ID NO: 440, wherein the traits are selected from: affinity for the polypeptide of SEQ ID NO: 2, expression, intracellular solubility, intracellular stability, and bioluminescent activity when combined with the polypeptide of SEQ ID NO: 2. In some embodiments, the internal tag is selected from the peptides of Table 2. In some embodiments, the N-terminal segment and the C-terminal segment, if directly linked in the absence of the internal tag, comprise the sequence of a first protein of interest. In some embodiments, a nucleic acid is provided comprising a sequence coding for the internally tagged polypeptide. In some embodiments, a bioluminescent complex is provided comprising: (a) the internally tagged polypeptide; and (b) a complement peptide having less than 100% and greater than 30% sequence identity with SEQ ID NO: 2. In some embodiments, the internal tag and the complement peptide have low affinity for each other. In some embodiments, the complement peptide is a fusion with a second protein of interest. In some embodiments, the fusion is an internal fusion or a traditional fusion. In some embodiments, the second protein of interest has an affinity for all or a portion of the N-terminal segment and/or the C-terminal segment. In some embodiments, the affinity may be altered by a structural modification to the first or second protein (e.g., a post-translational modification), or both, or by interaction with a third molecule (e.g., a drug, a nucleic acid, a protein, etc.). In some embodiments, the complement peptide is linked to a molecule of interest. In some embodiments, all or a portion of the N-terminal segment and/or the C-terminal segment has high affinity for the molecule of interest. In some embodiments, the bioluminescent complex further comprises a coelenterazine substrate. In some embodiments, the internal tag and the complement peptide have high affinity for each other. In some embodiments, the complement peptide is selected from the peptides of Table 1. In some embodiments, the complement peptide is not a fusion polypeptide or linked to a molecule of interest.

In some embodiments provided herein are methods of detecting an interaction between a first amino acid sequence and a second amino acid sequence comprising: (a) creating an internal fusion by inserting an internal tag into the first amino acid sequence, such that said internal tag is neither at the N-terminus not the C-terminus of the first amino acid sequence, wherein the internal tag has less than 100% and greater than 30% sequence identity with SEQ ID NO: 2, and wherein a detectable bioluminescent signal is produced in the presence of a coelenterazine substrate when the internal tag contacts a polypeptide of SEQ ID NO: 440; (b) creating a second fusion of the second amino acid sequence and a complement polypeptide, wherein the complement polypeptide has less than 100% and greater than 30% sequence identity with SEQ ID NO: 440, and wherein a detectable bioluminescent signal is produced in the presence of a coelenterazine substrate when the complement polypeptide contacts a peptide of SEQ ID NO: 2; (c) placing the internal fusion, second fusion, and a coelenterazine substrate in conditions that allow for a possible interaction to occur between the first amino acid sequence and the second amino acid sequence; and (d) detecting, if present, a bioluminescent signal emitted, wherein detection of the bioluminescent signal indicates an interaction between the first amino acid sequence and the second amino acid sequence. In some embodiments, the interaction is detected in living cells or organisms by detecting the bioluminescence signal emitted by the cells or organism. In some embodiments, an alteration in the interaction resulting from an alteration of the environment of the cells is detected by detecting a difference in the emitted bioluminescent signal relative to control cells absent the altered environment. In some embodiments, the altered environment is the result of adding or removing a molecule from the culture medium (e.g., a drug). In some embodiments, the second fusion is an internal fusion or a traditional fusion. In some embodiments, the internal fusion is expressed from a first nucleic acid sequence coding for the first amino acid sequence and the internal tag, and the second fusion is expressed from a second nucleic acid sequence coding for the second amino acid sequence and the complement polypeptide. In some embodiments, a single vector comprises the first nucleic acid sequence and the second nucleic acid sequence. In some embodiments, the first nucleic acid sequence and the second nucleic acid sequence are on separate vectors. In some embodiments, steps (a) and (b) comprise expressing the internal fusion and second fusion within a cell.

In some embodiments, provided herein are methods of detecting an interaction between a first amino acid sequence and a second amino acid sequence comprising: (a) creating an internal fusion by inserting an internal tag into the first amino acid sequence, such that said internal tag is neither at the N-terminus not the C-terminus of the first amino acid sequence, wherein the internal tag has less than 100% and greater than 30% sequence identity with SEQ ID NO: 440, and wherein a detectable bioluminescent signal is produced in the presence of a coelenterazine substrate when the internal tag contacts a peptide of SEQ ID NO: 2; (b) creating a second fusion of the second amino acid sequence and a complement peptide, wherein the complement peptide has less than 100% and greater than 30% sequence identity with SEQ ID NO: 2, and wherein a detectable bioluminescent signal is produced in the presence of a coelenterazine substrate when the complement peptide contacts a polypeptide of SEQ ID NO: 2; (c) placing the internal fusion, second fusion, and a coelenterazine substrate in conditions that allow for a possible interaction to occur between the first amino acid sequence and the second amino acid sequence; and (d) detecting, if present, a bioluminescent signal emitted, wherein detection of the bioluminescent signal indicates an interaction between the first amino acid sequence and the second amino acid sequence. In some embodiments, the second fusion is an internal fusion or a traditional fusion. In some embodiments, the internal fusion is expressed from a first nucleic acid sequence coding for the first amino acid sequence and the internal tag, and the second fusion is expressed from a second nucleic acid sequence coding for the second amino acid sequence and the complement peptide. In some embodiments, a single vector comprises the first nucleic acid sequence and the second nucleic acid sequence. In some embodiments, the first nucleic acid sequence and the second nucleic acid sequence are on separate vectors. In some embodiments, steps (a) and (b) comprise expressing the internal fusion and second fusion within a cell.

In some embodiments provided herein are methods of detecting a target polypeptide in a sample comprising: (a) creating an internal fusion by inserting an internal tag into the target polypeptide, such that said internal tag is neither at the N-terminus not the C-terminus of the target polypeptide, wherein the internal tag has less than 100% and greater than 30% sequence identity with SEQ ID NO: 440, and wherein a detectable bioluminescent signal is produced in the presence of a coelenterazine substrate when the internal tag contacts a peptide of SEQ ID NO: 2; (b) adding to said sample: (i) a complement peptide that has less than 100% and greater than 30% sequence identity with SEQ ID NO: 2, and (ii) a coelenterazine substrate; and (c) detecting, if present, a bioluminescent signal emitted, wherein detection of the bioluminescent signal indicates the presence of the target polypeptide in the sample. In some embodiments, the sample comprises a cell. In some embodiments, step (a) comprises expressing said internal fusion in said cell. In some embodiments, step (b)(i) comprises said complement peptide in said cell.

In some embodiments provided herein are methods of detecting a target polypeptide in a sample comprising: (a) creating an internal fusion by inserting an internal tag into the target polypeptide, such that said internal tag is neither at the N-terminus not the C-terminus of the target polypeptide, wherein the internal tag has less than 100% and greater than 30% sequence identity with SEQ ID NO: 2, and wherein a detectable bioluminescent signal is produced in the presence of a coelenterazine substrate when the internal tag contacts a peptide of SEQ ID NO: 440; (b) adding to said sample: (i) a complement polypeptide that has less than 100% and greater than 30% sequence identity with SEQ ID NO: 440, and (ii) a coelenterazine substrate; and (c) detecting, if present, a bioluminescent signal emitted, wherein detection of the bioluminescent signal indicates the presence of the target polypeptide in the sample. In some embodiments, the sample comprises a cell. In some embodiments, step (a) comprises expressing said internal fusion in said cell. In some embodiments, step (b)(i) comprises said complement polypeptide in said cell.

In some embodiments provided herein are detection reagents comprising: (a) a complement polypeptide comprising an amino acid sequence having less than 100% and greater than 30% sequence identity with SEQ ID NO: 440, wherein a detectable bioluminescent signal is produced, in the presence of a substrate, when the polypeptide contacts a peptide of SEQ ID NO: 2, and (b) a substrate for a bioluminescent complex produced by said polypeptide and a peptide of SEQ ID NO: 2.

In some embodiments provided herein are detection reagents comprising: (a) a complement peptide comprising an amino acid sequence having less than 100% and greater than 30% sequence identity with SEQ ID NO: 2, wherein a detectable bioluminescent signal is produced, in the presence of a substrate, when the peptide contacts a polypeptide of SEQ ID NO: 440, and (b) a substrate for a bioluminescent complex produced by said peptide and a polypeptide of SEQ ID NO: 440.

In certain embodiments, an internal tag and/or structural complement comprises or consists of an amino acid having 100% sequence identity with SEQ ID NO: 2 or SEQ ID NO: 440. In some embodiments, such internal tags and structural complements find use in any embodiments described herein and with any other peptide or polypeptide sequences described herein.

In some embodiments provided herein are methods of detecting alteration of an interaction between a first amino acid sequence and a second amino acid sequence by an agent comprising: (a) creating an internal fusion by inserting an internal tag into the first amino acid sequence, such that said internal tag is neither at the N-terminus not the C-terminus of the first amino acid sequence, wherein the internal tag has less than 100% and greater than 30% sequence identity with SEQ ID NO: 2, and wherein a detectable bioluminescent signal is produced in the presence of a coelenterazine substrate when the internal tag contacts a polypeptide of SEQ ID NO: 440; (b) creating a second fusion of the second amino acid sequence and a complement polypeptide, wherein the complement polypeptide has less than 100% and greater than 30% sequence identity with SEQ ID NO: 440, and wherein a detectable bioluminescent signal is produced in the presence of a coelenterazine substrate when the complement polypeptide contacts a peptide of SEQ ID NO: 2; (c) placing the internal fusion, second fusion, and a coelenterazine substrate in conditions that allow for a possible interaction to occur between the first amino acid sequence and the second amino acid sequence; (d) detecting, if present, a bioluminescent signal emitted; (e) adding the agent to the internal fusion, second fusion, and a coelenterazine substrate; (f) detecting, if present, a bioluminescent signal emitted; and (g) comparing the bioluminescent signals of steps (d) and (f), wherein change in bioluminescent signal from step (d) to step (f) indicates alteration of the interaction between the first amino acid sequence and the second amino acid sequence by the agent. In some embodiments, steps (a) and (b) comprise expressing the internal fusion and second fusion within a cell. In some embodiments, the agent is a peptide or small molecule. In some embodiments, the agent is an inhibitor of the interaction, wherein reduced interaction is detected by a decrease in the bioluminescent signal. In some embodiments, the agent is an activator of the interaction, wherein increased interaction is detected by an increase in the bioluminescent signal.

In some embodiments, provided herein are methods of detecting alteration of an interaction between a first amino acid sequence and a second amino acid sequence by an agent comprising: (a) creating an internal fusion by inserting an internal tag into the first amino acid sequence, such that said internal tag is neither at the N-terminus not the C-terminus of the first amino acid sequence, wherein the internal tag has less than 100% and greater than 30% sequence identity with SEQ ID NO: 440, and wherein a detectable bioluminescent signal is produced in the presence of a coelenterazine substrate when the internal tag contacts a peptide of SEQ ID NO: 2; (b) creating a second fusion of the second amino acid sequence and a complement polypeptide, wherein the complement peptide has less than 100% and greater than 30% sequence identity with SEQ ID NO: 2, and wherein a detectable bioluminescent signal is produced in the presence of a coelenterazine substrate when the complement polypeptide contacts a polypeptide of SEQ ID NO: 440; (c) placing the internal fusion, second fusion, and a coelenterazine substrate in conditions that allow for a possible interaction to occur between the first amino acid sequence and the second amino acid sequence; (d) detecting, if present, a bioluminescent signal emitted; (e) adding the agent to the internal fusion, second fusion, and a coelenterazine substrate; (f) detecting, if present, a bioluminescent signal emitted; and (g) comparing the bioluminescent signals of steps (d) and (f), wherein change in bioluminescent signal from step (d) to step (f) indicates alteration of the interaction between the first amino acid sequence and the second amino acid sequence by the agent. In some embodiments, steps (a) and (b) comprise expressing the internal fusion and second fusion within a cell. In some embodiments, the agent is a peptide or small molecule. In some embodiments, the agent is an inhibitor of the interaction, wherein reduced interaction is detected by a decrease in the bioluminescent signal. In some embodiments, the agent is an activator of the interaction, wherein increased interaction is detected by an increase in the bioluminescent signal.

In some embodiments provided herein are methods of detecting an alteration in the structural conformation of a first amino acid sequence by an agent comprising: (a) creating an internal fusion by inserting an internal tag into the first amino acid sequence, such that said internal tag is neither at the N-terminus not the C-terminus of the first amino acid sequence, wherein the internal tag has less than 100% and greater than 30% sequence identity with SEQ ID NO: 2, wherein a detectable bioluminescent signal is produced in the presence of a coelenterazine substrate when the internal tag contacts a polypeptide of SEQ ID NO: 440, wherein a first structural conformation of the first amino acid sequence alters access to the internal tag relative to a second structural conformation of the first amino acid sequence; (b) placing the internal fusion and either (i) a complement polypeptide having less than 100% and greater than 30% sequence identity with SEQ ID NO: 440 or (ii) a second fusion of a second amino acid sequence and the complement polypeptide in the presence of a coelenterazine substrate; (c) detecting, if present, a bioluminescent signal emitted; (d) adding the agent to the internal fusion, second fusion, and a coelenterazine substrate; (e) detecting, if present, a bioluminescent signal emitted; and (f) comparing the bioluminescent signals of steps (c) and (e), wherein change in bioluminescent signal from step (c) to step (e) indicates alteration of the conformation of the first amino acid sequence by the agent. In some embodiments, inducing a conformational change is selected from: adding a protease that cleave a portion of the first amino acid sequence, addition an agent that binds to the first amino acid sequence, and altering the assay conditions.

In some embodiments provided herein are methods of detecting an alteration in the structural conformation of a first amino acid sequence by an agent comprising (a) creating an internal fusion by inserting an internal tag into the first amino acid sequence, such that said internal tag is neither at the N-terminus not the C-terminus of the first amino acid sequence, wherein the internal tag has less than 100% and greater than 30% sequence identity with SEQ ID NO: 440, wherein a detectable bioluminescent signal is produced in the presence of a coelenterazine substrate when the internal tag contacts a peptide of SEQ ID NO: 2, wherein a first structural conformation of the first amino acid sequence alters access to the internal tag relative to a second structural conformation of the first amino acid sequence; (b) placing the internal fusion and either (i) a complement peptide having less than 100% and greater than 30% sequence identity with SEQ ID NO: 2 or (ii) a second fusion of a second amino acid sequence and the complement peptide in the presence of a coelenterazine substrate; (c) detecting, if present, a bioluminescent signal emitted; (d) adding the agent to the internal fusion, second fusion, and a coelenterazine substrate; (e) detecting, if present, a bioluminescent signal emitted; and (f) comparing the bioluminescent signals of steps (c) and (e), wherein change in bioluminescent signal from step (c) to step (e) indicates alteration of the conformation of the first amino acid sequence by the agent. In some embodiments, inducing a conformational change is selected from: adding a protease that cleaves a portion of the first amino acid sequence, adding an agent that binds to the first amino acid sequence, and altering the assay conditions.

In some embodiments provided herein are polypeptides comprising an N-terminal segment, a C-terminal segment, and two or more internal tags, wherein the internal tags comprise amino acid sequences having less than 100% and greater than 30% sequence identity with SEQ ID NO: 2 inserted within a protein of interest; wherein a detectable bioluminescent signal is produced in the presence of a coelenterazine substrate when one or more of the internal tags contact a polypeptide of SEQ ID NO: 440. In some embodiments, the two or more internal tags are two internal tags (e.g., tandem tags). In some embodiments, the two or more internal tags are directly connected to one another. In some embodiments, the two or more internal tags are separated by one or more linkers (e.g., peptide linker). In some embodiments, the two or more internal tags are inserted at a single location within the protein or polypeptide of interest. In some embodiments, the two or more internal tags are inserted at two or more locations within the protein or polypeptide of interest. In some embodiments, the two or more internal tags comprise identical amino acid sequences. In some embodiments, the two or more or the two or more internal tags comprise non-identical amino acid sequences. In some embodiments, the two or more internal tags have amino acid substitutions that may or may not have an impact on affinity with a complement sequence, but that change the overall charge of the internal tag or tandem tags to be either more charged or closer to neutral.

BRIEF DESCRIPTION OF THE DRAWINGS

FIG. 7 depicts the target protein of interest configurations with the NLpep114 tag either unencumbered on the C-terminus serving as a control, or placed between polypeptides as an internal tag. VEGFA is shown here as this target protein serves in the proof of concept data. Any soluble target protein of interest can be used. HT (Halotag), 114 (Small Bit), VEGF (Vascular Endothelial Growth Factor), FLAG (FLAG octapeptide). ATG 1915: Control Target with a terminal Small Bit; ATG 1917: Experimental Target with the Small Bit between two large domains; and ATG 1946: Experimental Target with the Small Bit between one large and one small domain.

DEFINITIONS

Figure 1:
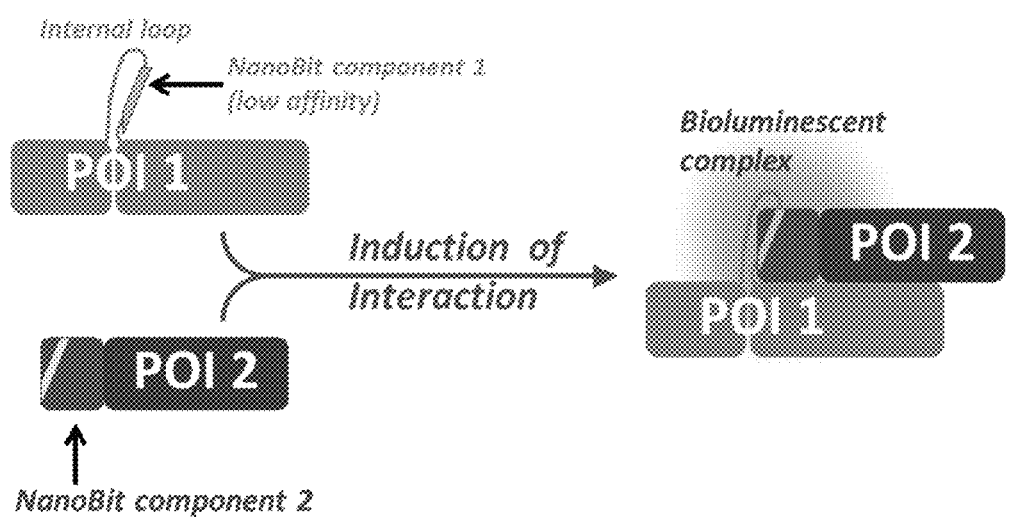
FIG. 1 shows a schematic depiction of an exemplary embodiment in which an internal tag (e.g., NLpep or NLpoly) is inserted into a first protein of interest (POI 1) as an internal loop, and a complement sequence (e.g., NLpep or NLpoly) is fused terminally to a second protein of interest (POI 2). The internal tag and complement sequence have low affinity for each other, such that they are ineffective in forming a complex (e.g., produce an undetectable or negligible amount of complex) in the absence of external forces. Although the internal tag and complement sequence are separately substantially non-luminescent, upon interaction of POI 1 and POI 2, a bioluminescent complex is formed between the internal tag and complement sequence.

As used herein, the term "internal tag" refers to a peptide or polypeptide sequence that is inserted within another polypeptide or protein (e.g., not at the N- or C-terminus). The internal tag may provide one or more characteristics of detection, isolation, localization, association, etc. to the peptide or polypeptide sequence within which it is inserted. An internal tag may either be directly connected to the N- and C-terminal portions of the polypeptide or protein or may be connected by one or more linkers. In some embodiments, the linkers themselves may provide a functionality.

As used herein, the term "substantially" means that the recited characteristic, parameter, and/or value need not be achieved exactly, but that deviations or variations, including for example, tolerances, measurement error, measurement accuracy limitations and other factors known to those of skill in the art, may occur in amounts that do not preclude the effect the characteristic was intended to provide. A characteristic or feature that is substantially absent (e.g., substantially non-luminescent) may be one that is within the noise, beneath background, or below the detection capabilities of the assay being used.

As used herein, the term "bioluminescence" refers to production and emission of light by a chemical reaction catalyzed by, or enabled by, an enzyme, protein, protein complex, or other biomolecule (e.g., bioluminescent complex). In typical embodiments, a substrate for a bioluminescent entity (e.g., bioluminescent protein or bioluminescent complex) is converted into a high-energy reaction product by the bioluminescent entity; the reaction product subsequently emits light as it converts to a more stable form.

As used herein the term "complementary" refers to the characteristic of two or more structural elements (e.g., peptide, polypeptide, nucleic acid, small molecule, etc.) of being able to hybridize, dimerize, or otherwise form a complex with each other. For example, a "complementary peptide and polypeptide" are capable of coming together to form a complex. Complementary elements may require assistance to form a stable complex (e.g., from interaction elements), for example, to place the elements in the proper conformation for complementarity, to co-localize complementary elements, to lower interaction energy for complementary, etc. In some embodiments, a "complement sequence", a "complement", or a "structural complement" is an amino acid sequence that is the structural complement of another sequence (e.g., of an internal tag).

As used herein, the term "complex" refers to an assemblage or aggregate of molecules (e.g., peptides, polypeptides, etc.) in direct and/or indirect contact with one another. In one aspect, "contact," or more particularly, "direct contact" means two or more molecules are close enough so that attractive noncovalent interactions between the molecules, such as Van der Waal forces, hydrogen bonding, ionic and hydrophobic interactions, and the like, influence the interaction of the molecules. As used herein, the term "complex", unless described as otherwise, refers to the assemblage of two or more molecules (e.g., peptides, polypeptides or a combination thereof).

As used herein, the term "non-luminescent" refers to an entity (e.g., peptide, polypeptide, complex, protein, etc.) that exhibits the characteristic of not emitting energy as light in the visible spectrum (e.g., in the presence or absence of a substrate). An entity may be referred to as non-luminescent if it does not exhibit detectable luminescence in a given assay. As used herein, the term "non-luminescent" is synonymous with the term "substantially non-luminescent." An entity is "non-luminescent" if any light emission is sufficiently minimal so as not to interfere with the intended purpose for a particular assay.

As used herein, the terms "non-luminescent peptide" (NLpep) and "non-luminescent polypeptide" (NLpoly) refer to peptides and polypeptides (e.g., an internal tag, a complement sequence, etc.) that exhibit substantially no luminescence (e.g., in the presence or absence of a substrate), or an amount that is virtually undetectable (e.g., beneath the noise) under standard conditions (e.g., physiological conditions, assay conditions, etc.) and with typical instrumentation (e.g., luminometer, etc.). In some embodiments, such non-luminescent peptides and polypeptides assemble, according to the criteria described herein, to form a bioluminescent complex. As used herein, a "non-luminescent element" is a non-luminescent peptide or non-luminescent polypeptide. The term "bioluminescent complex" refers to the assembled complex of two or more non-luminescent peptides and/or non-luminescent polypeptides. The bioluminescent complex catalyzes or enables the conversion of a substrate for the bioluminescent complex into a high-energy reaction product; the reaction product subsequently emits light as it converts to a more stable form. When uncomplexed, two non-luminescent elements that form a bioluminescent complex may be referred to as a "non-luminescent pair." If a bioluminescent complex is formed by three or more non-luminescent peptides and/or non-luminescent polypeptides, the uncomplexed constituents of the bioluminescent complex may be referred to as a "non-luminescent group." As used herein, the term "non-luminescent complex" refers to a complex of two or more elements (e.g., peptides, polypeptides, etc.) that does not does not substantially catalyze the conversion of a substrate for the bioluminescent complex into a high-energy reaction product. In some embodiments, a "non-luminescent complex" requires an additional non-luminescent element (e.g., a third element) to form a luminescent complex.

As used herein, the term "interaction element" refers to a moiety that assists in bringing together a pair of non-luminescent elements (e.g., an internal tag and a complement sequence) or a non-luminescent group (e.g., an internal tag and a complement sequence) to form a bioluminescent complex. In a typical embodiment, a pair of interaction elements (a.k.a. "interaction pair") is attached to a pair of non-luminescent elements (e.g., non-luminescent peptide/ polypeptide pair), and the attractive interaction between the two interaction elements facilitates formation of the bioluminescent complex; although the present invention is not limited to such a mechanism, and an understanding of the mechanism is not required to practice the invention. Interaction elements may facilitate formation of the bioluminescent complex by any suitable mechanism (e.g., bringing non-luminescent pair/group into close proximity, placing a non-luminescent pair/group in proper conformation for interaction, reducing activation energy for complex formation, combinations thereof, etc.). An interaction element may be a protein, polypeptide, peptide, small molecule, cofactor, nucleic acid, lipid, carbohydrate, antibody, polymer, particle, etc. An interaction pair may be made of two of the same interaction elements (i.e. homopair) or two different interaction elements (i.e. heteropair). In the case of a heteropair, the interaction elements may be the same type of moiety (e.g., polypeptides) or may be two different types of moieties (e.g., polypeptide and small molecule). In some embodiments, in which complex formation by the interaction pair is studied, an interaction pair may be referred to as a "target pair" or a "pair of interest," and the individual interaction elements are referred to as "target elements" (e.g., "target peptide," "target polypeptide," etc.) or "elements of interest" (e.g., "peptide of interest," "polypeptide or interest," etc.).

As used herein, the term "preexisting protein" refers to an amino acid sequence that was in physical existence prior to a certain event or date. A "peptide that is not a fragment of a preexisting protein" is a short amino acid chain that is not a fragment or sub-sequence of a protein (e.g., synthetic or naturally-occurring) that was in physical existence prior to the design and/or synthesis of the peptide.

As used herein, the term "fragment" refers to a peptide or polypeptide that results from dissection or "fragmentation" of a larger whole entity (e.g., protein, polypeptide, enzyme, etc.), or a peptide or polypeptide prepared to have the same sequence as such. Therefore, a fragment is a subsequence of the whole entity (e.g., protein, polypeptide, enzyme, etc.) from which it is made and/or designed. A peptide or polypeptide that is not a subsequence of a preexisting whole protein is not a fragment (e.g., not a fragment of a preexisting protein). A peptide or polypeptide that is "not a fragment of a preexisting bioluminescent protein" is an amino acid chain that is not a subsequence of a protein (e.g., natural of synthetic) that: (1) was in physical existence prior to design and/or synthesis of the peptide or polypeptide, and (2) exhibits substantial bioluminescent activity.

As used herein, the term "subsequence" refers to a peptide or polypeptide that has 100% sequence identify with another, larger peptide or polypeptide. The subsequence is a perfect sequence match for a portion of the larger amino acid chain.

As used herein, the term "sequence identity" refers to the degree two polymer sequences (e.g., peptide, polypeptide, nucleic acid, etc.) have the same sequential composition of monomer subunits. The term "sequence similarity" refers to the degree with which two polymer sequences (e.g., peptide, polypeptide, nucleic acid, etc.) have similar polymer sequences. For example, similar amino acids are those that share the same biophysical characteristics and can be grouped into the families, e.g., acidic (e.g., aspartate, glutamate), basic (e.g., lysine, arginine, histidine), non-polar (e.g., alanine, valine, leucine, isoleucine, proline, phenylalanine, methionine, tryptophan) and uncharged polar (e.g., glycine, asparagine, glutamine, cysteine, serine, threonine, tyrosine). The "percent sequence identity" (or "percent sequence similarity") is calculated by: (1) comparing two optimally aligned sequences over a window of comparison (e.g., the length of the longer sequence, the length of the shorter sequence, a specified window), (2) determining the number of positions containing identical (or similar) monomers (e.g., same amino acids occurs in both sequences, similar amino acid occurs in both sequences) to yield the number of matched positions, (3) dividing the number of matched positions by the total number of positions in the comparison window (e.g., the length of the longer sequence, the length of the shorter sequence, a specified window), and (4) multiplying the result by 100 to yield the percent sequence identity or percent sequence similarity. For example, if peptides A and B are both 20 amino acids in length and have identical amino acids at all but 1 position, then peptide A and peptide B have 95% sequence identity. If the amino acids at the non-identical position shared the same biophysical characteristics (e.g., both were acidic), then peptide A and peptide B would have 100% sequence similarity. As another example, if peptide C is 20 amino acids in length and peptide D is 15 amino acids in length, and 14 out of 15 amino acids in peptide D are identical to those of a portion of peptide C, then peptides C and D have 70% sequence identity, but peptide D has 93.3% sequence identity to an optimal comparison window of peptide C. For the purpose of calculating "percent sequence identity" (or "percent sequence similarity") herein, any gaps in aligned sequences are treated as mismatches at that position.

As used herein, the term "physiological conditions" encompasses any conditions compatible with living cells, e.g., predominantly aqueous conditions of a temperature, pH, salinity, chemical makeup, etc. that are compatible with living cells.

As used herein, the term "sample" is used in its broadest sense. In one sense, it is meant to include a specimen or culture obtained from any source as well as biological and environmental samples. Biological samples may be obtained from animals (including humans) and encompass fluids, solids, tissues, and gases. Biological samples include blood products, such as plasma, serum and the like. Sample may also refer to cell lysates or purified forms of the peptides and/or polypeptides described herein. Cell lysates may include cells that have been lysed with a lysing agent or lysates such as rabbit reticulocyte or wheat germ lysates. Sample may also include cell-free expression systems. Environmental samples include environmental material such as surface matter, soil, water, and industrial samples. Such examples are not however to be construed as limiting the sample types applicable to the present invention.

As used herein, unless otherwise specified, the terms "peptide" and "polypeptide" refer to polymer compounds of two or more amino acids joined through the main chain by peptide amide bonds (—C(O)NH—). The term "peptide" typically refers to short amino acid polymers (e.g., chains having fewer than 25 amino acids), whereas the term "polypeptide" typically refers to longer amino acid polymers (e.g., chains having more than 25 amino acids).

As used herein, the terms "fusion", "fusion polypeptide", and "fusion protein" refer to a chimeric protein containing a first protein or polypeptide of interest (e.g., target sequence, etc.) joined to a second different peptide, polypeptide, or protein (e.g., detectable sequence, isolatable sequence, tag, etc.). The term "internal fusion", as used herein, refers to a fusion in which the second peptide, polypeptide, or protein is inserted at a position within the sequence of the first (e.g., not at the N- or C-terminus). The term "traditional fusion" refers to a fusion in which the first polypeptide or protein and the second peptide, polypeptide, or protein are fused end to end (e.g., C-terminus to N-terminus or N-terminus to C-terminus).

As used herein, the terms "coelenterazine" or "coelenterazine substrate" refer to naturally-occurring ("native") coelenterazine. As used herein, the terms "a coelenterazine" or "a coelenterazine substrate" refers to native coelenterazine as well as synthetic, e.g., derivative or variant, and natural analogs thereof, including furimazine, coelenterazine-n, coelenterazine-f, coelenterazine-h, coelenterazine-hcp, coelenterazine-cp, coelenterazine-c, coelenterazine-e, coelenterazine-fcp, bis-deoxycoelenterazine ("coelenterazine-hh"), coelenterazine-i, coelenterazine-icp, coelenterazine-v, and 2-methyl coelenterazine, in addition to those disclosed in WO 2003/040100; U.S. application Ser. No. 12/056,073 (paragraph [0086]); and U.S. Pat. No. 8,669,103; the disclosures of which are incorporated by reference herein in their entireties.

As used herein, the term "low affinity" describes an intermolecular interaction between two entities (e.g., protein-protein) that is too weak to result in significant complex formation between the entities, except at concentrations substantially higher (e.g., 2-fold, 5-fold, 10-fold, 100-fold, 1000-fold, or more) than physiologic or assay conditions.

As used herein, the term "high affinity" describes an intermolecular interaction between two entities that is of sufficient strength to produce detectable complex formation under physiologic or assay conditions.

DETAILED DESCRIPTION

Tagging of proteins with reporters is commonly used to analyze protein function and behavior. In general, genetic fusions are generated using either the C- or N-terminus of the protein of interest. However, in certain cases, both termini are relevant to function of the protein of interest, and therefore cannot be modified without altering the physiological function of the protein. Embodiments described herein enable, for example, the analysis of protein-protein interactions without the need of modification of either the N- or C-terminus. Embodiments further enable detection and/or localization (e.g., cellular or subcellular localization) of a protein without the need of modification of either the N- or C-terminus. Various proteins undergo modifications that lead to changes in configuration; using an internal peptide/polypeptide tag that is accessible for structural complementation based on the configuration of the host protein enables the generation of biosensors using full length proteins. Therefore, provided herein are substantially non-luminescent peptide/polypeptide tags that are inserted internally within a protein of interest. Interaction of the internally-inserted tag with a complement polypeptide/peptide that is also substantially non-luminescent results in the formation a bioluminescent reporter complex.

Provided herein are compositions and methods for the assembly of a bioluminescent complex from an internal tag (e.g., peptide or polypeptide) of a protein or polypeptide and a structural complement thereof (e.g., free or in a fusion (e.g., internal or terminal)). In some embodiments, the internal tag and/or structural complement are not fragments of a preexisting protein (e.g., are not complementary subsequences of a known polypeptide sequence). In particular, bioluminescent activity is conferred upon a substantially non-luminescent internal tag of a protein/polypeptide via structural complementation with a substantially non-luminescent peptide structural complement sequence of the internal tag.

In some embodiments provided herein are substantially non-luminescent internal tags and structural complements thereof for use in detecting the presence of proteins/polypeptides of interest, and for monitoring molecular interactions (e.g., protein-protein, protein-DNA, protein-RNA interactions, protein-small molecule, etc.). Also provided herein are complementary panels of interchangeable internal tags and structural complement sequences (e.g., peptides and polypeptides) that have variable affinities and luminescence upon formation of the various bioluminescent complexes (e.g., a high-affinity/high-luminescence pair, a moderate-affinity/high-luminescence pair, a low-affinity/moderate-luminescence pair, etc.). Utilizing different combinations of internal tags and structural complements provides an adaptable system comprising various pairs ranging from lower to higher affinities, luminescence and other variable characteristics. This adaptability allows the detection/monitoring of proteins of interest and their molecular interactions to be fine-tuned to the specific molecule(s) of interest and expands the range of molecular interactions that can be monitored to include interactions with very high or low affinities. Further provided herein are methods by which internal tags, structural complements, and panels thereof are developed and tested.

In some embodiments, the affinity between the internal tag and the structural complement alone is insufficient to form the active (e.g., bioluminescent) complex and produce the resulting signal (e.g., bioluminescent signal). However, if the structural complement is fused, tethered, attached, etc., to an interaction moiety (e.g., peptide, protein, nucleic acid, small molecule, etc.) that interacts with the internally tagged polypeptide, then that interaction (e.g., complex formation between the polypeptide of interest and the interaction moiety) facilitates formation of the bioluminescent complex. In such embodiments, the signal from the bioluminescent complex in the presence of a substrate serves as an indication for the formation of the complex of the polypeptide of interest and the integration moiety (a.k.a., interaction complex). If an interaction complex is formed, then a bioluminescent complex is formed, and a bioluminescent signal is generated, which can then be detected/measured/monitored (e.g., in the presence of substrate). If an interaction complex fails to form (e.g., due to unfavorable conditions, due to unstable interaction between the interaction elements, due to incompatible interaction elements, etc.), then a stable bioluminescent complex does not form, and a bioluminescent signal is not produced.

In certain embodiments, an internally tagged polypeptide and a second moiety that interacts (e.g., forms a complex) therewith are known as an interaction pair. In some embodiments, an interaction pair comprises two molecules of interest (e.g., proteins of interest). In some embodiments, at least one member of an interaction pair is internally tagged. In some embodiments, both members of an interaction pair are internally tagged (e.g., with structurally complementary internal tags). In some embodiments, one member of an interaction pair is internally tagged and the other is terminally tagged. For example, assays are performed to detect the interaction of a protein of interest and a second molecule of interest (e.g., peptide, protein, nucleic acid, small molecule, etc.) by inserting an internal tag into the protein of interest and tethering (e.g., internal tag, terminal tag, etc.) the molecule of interest to a structural complement of the internal tag. If the protein of interest and the molecule of interest interact (e.g., transiently interact, stably interact, etc.), the internal tag and structural complement are brought into close proximity in a suitable conformation to form an active complex (e.g., a bioluminescent complex) signal is produced/detected (e.g., in the presence of substrate). In the absence of an interaction between the protein of interest and the molecule of interest, the internal tag and structural complement do not interact in a stable enough manner, and a signal is not produced or only weakly produced. Such embodiments find use to study the effect of inhibitors on complex formation, the effect of mutations on complex formation, the effect of conditions (e.g., temperature, pH, etc.) on complex formation, the interaction of a small molecule (e.g., potential therapeutic) with a target molecule, etc.

In some embodiments, an internally-tagged protein of interest is monitored (e.g., detected, localized, etc.) by the formation of an active (e.g., bioluminescent) complex with a free structural complement. In such embodiments, an internal tag and structural complement are selected with sufficiently high affinity for each other such that detectable complex forms when both an internally tagged protein and the free structural complement are present.

Different internal tag and structural complement pairs may require different strength, duration and/or stability of the interaction complex to result in active (e.g., bioluminescent) complex formation. In some embodiments, a stable interaction complex is required to produce a detectable (e.g., bioluminescent) signal. In other embodiments, even a weak or transient interaction complex results in active (e.g., bioluminescent) complex formation. In some embodiments, the strength of an interaction complex is directly proportional to the strength of the resulting (e.g., bioluminescent) signal. Some internal tag and structural complement pairs produce a detectable signal when combined with an interaction pair (e.g., internally-tagged protein of interest and interaction partner) with a high millimolar dissociation constant (e.g., $K_d > 100$ mM). Other internal tag and structural complement pairs require an interaction pair with a low millimolar (e.g., $K_d < 100$ mM), micromolar (e.g., $K_d < 1$ mM), nanomolar (e.g., $K_d < 1$ μM), or even picomolar (e.g., $K_d < 1$ nM) dissociation constant in order to produce a bioluminescent complex with a detectable signal. Still other internal tag and structural complement pairs form an active complex in the absence of any interaction pair.

In some embodiments, one or both of the internal tag and structural complement are not fragments of a pre-existing protein. In some embodiments, one or both of the internal tag and structural complement are not fragments of a pre-existing bioluminescent protein. In some embodiments, neither the internal tag nor the structural complement is a fragment of a pre-existing protein. In some embodiments, neither the internal tag nor the structural complement is a fragment of a pre-existing bioluminescent protein.

In some embodiments, both the internal tag and its structural complement are substantially inactive (e.g., non-luminescent) in isolation. In certain embodiments, when placed in suitable conditions (e.g., physiological conditions), the substantially non-luminescent internal tag and its substantially non-luminescent structural complement interact to form a bioluminescent complex and produce a bioluminescent signal in the presence of substrate. In some embodiments, an internal tag and its structural complement produce a low level of activity (e.g., bioluminescence) in each other's presence, but undergo a significant increase in detectable activity (e.g., bioluminescence) under a particular set of conditions.

In some embodiments, compositions and methods described herein comprise one or more interaction elements. In a typical embodiment, an interaction element is a moiety (e.g., peptide, polypeptide, protein, small molecule, nucleic acid, lipid, carbohydrate, etc.) that is attached to a structural complement of the internally tag, and associates or forms a complex with the internally-tagged protein to facilitate assembly of the complex of the internal tag and its structural complement.

In some embodiments, an interaction pair comprises the internally-tagged protein or polypeptide and any other suitable chemical moiety that interacts with the internally-tagged protein or polypeptide to facilitate assembly of the active complex of the internal tag and its structural complement. An interaction pair may consist of, for example: an internally tagged protein and: a nucleic acid, a polypeptide, a protein, a ligand, a small molecule, an antibody, a lipid, etc. Any molecular entity capable of interacting with the internally tagger protein or polypeptide may find use in some embodiments herein.

In some embodiments, compositions and methods herein provide useful assays (e.g., in vitro, in vivo, in situ, whole animal, etc.) for studying the interactions between a pair of target molecules (e.g., the internally-tagged protein and a (potential) interaction partner).

In some embodiments, the presence of a ligand, substrate, co-factor, etc., is necessary to induce the interaction between the internally-tagged protein and its interaction partner, in order to facilitate formation of the complex (e.g., bioluminescent complex) between the internal tag and the structural complement linked to the interaction partner. In some embodiments, detecting a signal from the bioluminescent complex indicates the presence of the ligand, substrate, co-factor, etc.

In some embodiments, an internal tag and its structural complement are present in a single amino acid chain (e.g., N-(amino acid sequence 1)-(internal tag)-(amino acid sequence 2)-(structural complement)-C, etc.). In some embodiments, folding of the protein of interest results in formation of the active complex (e.g., bioluminescent complex).

In some embodiments, an internally-tagged protein and fusion of an interaction peptide or polypeptide and a structural complement of the internal tag are expressed within the same cells. In such embodiments, an internally-tagged protein and fusion of an interaction peptide or polypeptide and a structural complement of the internal tag are purified and/or isolated from the cells, or the interaction is assayed within the cells. In some embodiments, an internally-tagged protein and fusion of an interaction peptide or polypeptide and a structural complement of the internal tag are stably expressed. In some embodiments, an internally-tagged protein and fusion of an interaction peptide or polypeptide and a structural complement of the internal tag are transiently expressed. In other embodiments, an internally-tagged protein and fusion of an interaction peptide or polypeptide and a structural complement of the internal tag are expressed in separate cells and combined (e.g., following purification and/or isolation) for signal detection. In some embodiments, an internally-tagged protein and fusion of an interaction peptide or polypeptide and a structural complement of the internal tag are expressed in cell lysate (e.g., rabbit reticulocyte lysate) or in a cell-free system.

In certain embodiments, nucleic acids, DNA, RNA, vectors, etc. are provided that encode the peptides, polypeptides, fusion polypeptides, fusion proteins, etc., described herein. Such nucleic acids and vectors may be used for expression, transformation, transfection, injection, etc.

In some embodiments, an internal tag is attached (e.g., on its N-terminus, on its C-terminus, at both ends) to polypeptide sequence by a linker. In some embodiments, structural complement is attached (e.g., on its N-terminus, on its C-terminus, at both ends) to a molecule of interest (e.g., protein of interest) by a linker. In some embodiments, a linker provides a connection and allows a desired amount of space/distance between the elements. In certain embodiments, a linker provides appropriate attachment chemistry between the linked elements. In some embodiments, a linker is any suitable chemical moiety capable of linking, connecting, or tethering two elements (e.g., peptides, polypeptides, small molecules, etc.). In some embodiments, a linker is a polymer of one or more repeating or non-repeating monomer units (e.g., nucleic acid, amino acid, carbon-containing polymer, carbon chain, etc.). A wide variety of linkers may be used. In some embodiments, the linker is a single covalent bond. In some embodiments, the linker comprises a linear or branched, cyclic or heterocyclic, saturated or unsaturated, structure having 1-20 nonhydrogen atoms (e.g., C, N, P, O and S) and is composed of any combination of alkyl, ether, thioether, imine, carboxylic, amine, ester, carboxamide, sulfonamide, hydrazide bonds and aromatic or heteroaromatic bonds. In some embodiments, linkers are longer than 20 nonhydrogen atoms (e.g. 21 non-hydrogen atoms, 25 non-hydrogen atoms, 30 non-hydrogen atoms, 40 non-hydrogen atoms, 50 non-hydrogen atoms, 100 non-hydrogen atoms, etc.) In some embodiments, the linker comprises 1-50 non-hydrogen atoms (in addition to hydrogen atoms) selected from the group of C, N, P, O and S (e.g. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 non-hydrogen atoms).

The present invention is not limited by the types of linkers available. The signal and interaction elements are linked, either directly (e.g. linker consists of a single covalent bond) or linked via a suitable linker. The present invention is not limited to any particular linker group. A variety of linker groups are contemplated, and suitable linkers could comprise, but are not limited to, alkyl groups, methylene carbon chains, ether, polyether, alkyl amide linker, a peptide linker, a modified peptide linker, a Poly(ethylene glycol) (PEG) linker, a streptavidin-biotin or avidin-biotin linker, polyaminoacids (e.g. polylysine), functionalised PEG, polysaccharides, glycosaminoglycans, dendritic polymers (WO93/06868 and by Tomalia et al. in Angew. Chem. Int. Ed. Engl. 29:138-175 (1990), herein incorporated by reference in their entireties), PEG-chelant polymers (W94/08629, WO94/09056 and WO96/26754, herein incorporated by reference in their entireties), oligonucleotide linker, phospholipid derivatives, alkenyl chains, alkynyl chains, disulfide, or a combination thereof.

In some embodiments, the linker is cleavable (e.g., enzymatically (e.g., TEV protease site), chemically, photoinduced, etc.).

In some embodiments, substantially non-luminescent internal tags are directly linked to peptide and/or polypeptide sequences. In some embodiments, two or more internal tags reside at a location internal to a polypeptide of interest. In some embodiments, one or more internal tags serve a linker function, rather than a reporter function.

In some embodiments, substantially non-luminescent internal tags and structural complements thereof are provided with less than 100% sequence identity and/or similarity to any portion of an existing luciferase (e.g., a firefly luciferase, a Renilla luciferase, an Oplophorus luciferase, enhanced Oplophorus luciferases as described in U.S. Pat. No. 8,557,970; U.S. Pat. App. 2014/0120548; U.S. Pat. No. 8,669,103; U.S. patent application Ser. No. 14/160,278; and U.S. patent application Ser. No. 14/160,282, herein incorporated by reference in their entireties). Certain embodiments of the present invention involve the formation of bioluminescent complexes of substantially non-luminescent internal tags and substantially non-luminescent structural complements with less than 100%, but more than 30% (e.g., >30%, >40%, >45%, >50%, >55%, >60%, >65%, >70%, >75%, >80%, >85%, >90%, >95%, >98%, >99%) sequence identity with all or a portion (e.g., >5, >8, >10, >12, >15, >20, <15, <18, <20, <22, <25, <30, <40, and ranges defined thereby) of SEQ ID NO: 2157 (e.g., complete NANOLUC sequence). In some embodiments, substantially non-luminescent internal tags and substantially non-luminescent structural complements are provided with less than 100%, but more than 30% (e.g., >30%, >40%, >45%, >50%, >55%, >60%, >65%, >70%, >75%, >80%, >85%, >90%, >95%, >98%, >99%) sequence similarity with a portion (e.g., >5, >8, >10, >12, >15, >20, <15, <18, <20, <22, <25, <30, <40, and ranges defined thereby) of SEQ ID NO: 2157 (e.g., peptides and polypeptides that interact to form bioluminescent complexes). In some embodiments, substantially non-luminescent internal tags and substantially non-luminescent structural complements are provided that have less than 100%, but more than 30% (e.g., >30%, >40%, >45%, >50%, >55%, >60%, >65%, >70%, >75%, >80%, >85%, >90%, >95%, >98%, >99%) sequence identity and/or similarity with about a 25 amino acid or less portion of SEQ ID NO: 2157, wherein such peptides form a bioluminescent complex when combined under appropriate conditions (e.g., stabilized by an interaction pair) with a polypeptide having less than 100%, but more than 30% (e.g., >30%, >40%, >45%, >50%, >55%, >60%, >65%, >70%, >75%, >80%, >85%, >90%, >95%, >98%, >99%) sequence identity and/or similarity with another portion SEQ ID NO: 2157. Similarly, substantially non-luminescent internal tags and substantially non-luminescent structural complements are provided that have less than 100%, but more than 40% (e.g., >40%, >45%, >50%, >55%, >60%, >65%, >70%, >75%, >80%, >85%, >90%, >95%, >98%, >99%) sequence identity or similarity with a portion of SEQ ID NO: 2157, wherein such substantially non-luminescent internal tags and substantially non-luminescent structural complements form a bioluminescent complex when combined under appropriate conditions (e.g., stabilized by an interaction pair) with a peptide having less than 100%, but more than 30% (e.g., >30%, >40%, >45%, >50%, >55%, >60%, >65%, >70%, >75%, >80%, >85%, >90%, >95%, >98%, >99%) sequence identity and/or similarity with another portion SEQ ID NO: 2157. In some embodiments, substantially non-luminescent internal tags and substantially non-luminescent structural complements with less than 100%, but more than 30% (e.g., >30%, >40%, >45%, >50%, >55%, >60%, >65%, >70%, >75%, >80%, >85%, >90%, >95%, >98%, >99%) sequence identity or similarity with SEQ ID NO: 2 are provided. In some embodiments, substantially non-luminescent internal tags and substantially non-luminescent structural complements with less than 100%, but more than 30% (e.g., >30%, >40%, >45%, >50%, >55%, >60%, >65%, >70%, >75%, >80%, >85%, >90%, >95%, >98%, >99%) sequence identity or similarity with SEQ ID NO: 440 are provided.

In some embodiments, internal tags and/or structural complements that find use in embodiments of the present invention include peptides with one or more amino acid substitutions, deletions, or additions from GVTGWRLCKRILA (SEQ ID NO: 2). In some embodiments, the provided herein are internal tags and/or structural complements comprising an amino acid sequence of Table 1, and/or nucleic acids comprising the nucleic acid sequences of Table 1 (which code for the peptide sequences of Table 1).

TABLE 1

Exemplary internal tag and/or structural complement peptide sequences

| SEQ ID NO. | PEPTIDE NO. | POLYMER | SEQUENCE |
|---|---|---|---|
| 3 | NLpep2 (w/ Met) | N.A. | ATGGACGTGACCGGCTGGCGGCTGTGCGAACGCATTCTGGCG |
| 4 | NLpep2 (w/ Met) | A.A. | MDVTGWRLCERILA |
| 5 | NLpep3 (w/ Met) | N.A. | ATGGGAGTGACCGCCTGGCGGCTGTGCGAACGCATTCTGGCG |
| 6 | NLpep3 (w/ Met) | A.A. | MGVTAWRLCERILA |
| 7 | NLpep4 (w/ Met) | N.A. | ATGGGAGTGACCGGCTGGCGGCTGTGCAAGCGCATTCTGGCG |
| 8 | NLpep4 (w/ Met) | A.A. | MGVTGWRLCKRILA |
| 9 | NLpep5 (w/ Met) | N.A. | ATGGGAGTGACCGGCTGGCGGCTGTGCGAACGCATTAGCGCG |
| 10 | NLpep5 (w/ Met) | A.A. | MGVTGWRLCERISA |
| 11 | NLpep6 (w/ Met) | N.A. | ATGGACGTGACCGGCTGGCGGCTGTGCAAGCGCATTAGCGCG |
| 12 | NLpep6 (w/ Met) | A.A. | MDVTGWRLCKRISA |
| 13 | NLpep7 (w/ Met) | N.A. | ATGGACGTGACCGGCTGGCGGCTGTGCAAGCGCATTCTGGCG |
| 14 | NLpep7 (w/ Met) | A.A. | MDVTGWRLCKRILA |
| 15 | NLpep8 (w/ Met) | N.A. | ATGGACGTGACCGGCTGGCGGCTGTGCGAACGCATTAGCGCG |
| 16 | NLpep8 (w/ Met) | A.A. | MDVTGWRLCERISA |
| 17 | NLpep9 (w/ Met) | N.A. | ATGGGAGTGACCGGCTGGCGGCTGTGCAAGCGCATTAGCGCG |
| 18 | NLpep9 (w/ Met) | A.A. | MGVTGWRLCKRISA |
| 19 | NLpep10 (w/ Met) | N.A. | ATGGGAGTGACCGGCTGGCGGCTGAACGAACGCATTCTGGCG |

TABLE 1-continued

Exemplary internal tag and/or structural complement peptide sequences

| SEQ ID NO. | PEPTIDE NO. | | POLYMER SEQUENCE |
|---|---|---|---|
| 20 | NLpep10 (w/ Met) | A.A. | MGVTGWRLNERILA |
| 21 | NLpep11 (w/ Met) | N.A. | ATGGGAGTGACCGGCTGGCGGCTGCAGGAACGCATTCTGGCG |
| 22 | NLpep11 (w/ Met) | A.A. | MGVTGWRLQERILA |
| 23 | NLpep12 (w/ Met) | N.A. | ATGGGAGTGACCGGCTGGCGGCTGAAGAAGCGCCGGAGCCGG |
| 24 | NLpep12 (w/ Met) | A.A. | MGVTGWRLKKRRSR |
| 25 | NLpep13 (w/ Met) | N.A. | ATGAACGTGACCGGCTGGCGGCTGTGCAAGCGCATTAGCGCG |
| 26 | NLpep13 (w/ Met) | A.A. | MNVTGWRLCKRISA |
| 27 | NLpep14 (w/ Met) | N.A. | ATGAGCGTGACCGGCTGGCGGCTGTGCAAGCGCATTAGCGCG |
| 28 | NLpep14 (w/ Met) | A.A. | MDVTGWRLCKRISA |
| 29 | NLpep15 (w/ Met) | N.A. | ATGGAGGTGACCGGCTGGCGGCTGTGCAAGCGCATTAGCGCG |
| 30 | NLpep15 (w/ Met) | A.A. | MEVTGWRLCKRISA |
| 31 | NLpep16 (w/ Met) | N.A. | ATGGGCGTGACCGGCTGGCGGCTGTGCAAGCGCATTAGCGCG |
| 32 | NLpep16 (w/ Met) | A.A. | MHVTGWRLCKRISA |
| 33 | NLpep17 (w/ Met) | N.A. | ATGGGACACACCGGCTGGCGGCTGTGCAAGCGCATTAGCGCG |
| 34 | NLpep17 (w/ Met) | A.A. | MGITGWRLCKRISA |
| 35 | NLpep18 (w/ Met) | N.A. | ATGGGAGCCACCGGCTGGCGGCTGTGCAAGCGCATTAGCGCG |
| 36 | NLpep18 (w/ Met) | A.A. | MGATGWRLCKRISA |
| 37 | NLpep19 (w/ Met) | N.A. | ATGGGAAAGACCGGCTGGCGGCTGTGCAAGCGCATTAGCGCG |
| 38 | NLpep19 (w/ Met) | A.A. | MGKTGWRLCKRISA |
| 39 | NLpep20 (w/ Met) | N.A. | ATGGGACAGACCGGCTGGCGGCTGTGCAAGCGCATTAGCGCG |
| 40 | NLpep20 (w/ Met) | A.A. | MGQTGWRLCKRISA |
| 41 | NLpep21 (w/ Met) | N.A. | ATGGGAAGCACCGGCTGGCGGCTGTGCAAGCGCATTAGCGCG |
| 42 | NLpep21 (w/ Met) | A.A. | MGSTGWRLCKRISA |
| 43 | NLpep22 (w/ Met) | N.A. | ATGGGAGTGGTGGGCTGGCGGCTGTGCAAGCGCATTAGCGCG |
| 44 | NLpep22 (w/ Met) | A.A. | MGVVGWRLCKRISA |
| 45 | NLpep23 (w/ Met) | N.A. | ATGGGAGTGAAGGGCTGGCGGCTGTGCAAGCGCATTAGCGCG |
| 46 | NLpep23 (w/ Met) | A.A. | MGVKGWRLCKRISA |
| 47 | NLpep24 (w/ Met) | N.A. | ATGGGAGTGCAGGGCTGGCGGCTGTGCAAGCGCATTAGCGCG |
| 48 | NLpep24 (w/ Met) | A.A. | MGVQGWRLCKRISA |
| 49 | NLpep25 (w/ Met) | N.A. | ATGGGAGTGACCGGCACCCGGCTGTGCAAGCGCATTAGCGCG |
| 50 | NLpep25 (w/ Met) | A.A. | MGVTGTRLCKRISA |
| 51 | NLpep26 (w/ Met) | N.A. | ATGGGAGTGACCGGCAAGCGGCTGTGCAAGCGCATTAGCGCG |
| 52 | NLpep26 (w/ Met) | A.A. | MGVTGKRLCKRISA |
| 53 | NLpep27 (w/ Met) | N.A. | ATGGGAGTGACCGGCGTGCGGCTGTGCAAGCGCATTAGCGCG |
| 54 | NLpep27 (w/ Met) | A.A. | MGVTGVRLCKRISA |
| 55 | NLpep28 (w/ Met) | N.A. | ATGGGAGTGACCGGCTGGCGGCACTGCAAGCGCATTAGCGCG |
| 56 | NLpep28 (w/ Met) | A.A. | MGVTGWRICKRISA |

TABLE 1-continued

Exemplary internal tag and/or structural complement peptide sequences

| SEQ ID NO. | PEPTIDE NO. | | POLYMER SEQUENCE |
|---|---|---|---|
| 57 | NLpep29 (w/ Met) | N.A. | ATGGGAGTGACCGGCTGGCGGGTGTGCAAGCGCATTAGCGCG |
| 58 | NLpep29 (w/ Met) | A.A. | MGVTGWRVCKRISA |
| 59 | NLpep30 (w/ Met) | N.A. | ATGGGAGTGACCGGCTGGCGGACCTGCAAGCGCATTAGCGCG |
| 60 | NLpep30 (w/ Met) | A.A. | MGVTGWRTCKRISA |
| 61 | NLpep31 (w/ Met) | N.A. | ATGGGAGTGACCGGCTGGCGGTACTGCAAGCGCATTAGCGCG |
| 62 | NLpep31 (w/ Met) | A.A. | MGVTGWRYCKRISA |
| 63 | NLpep32 (w/ Met) | N.A. | ATGGGAGTGACCGGCTGGCGGAAGTGCAAGCGCATTAGCGCG |
| 64 | NLpep32 (w/ Met) | A.A. | MGVTGWRKCKRISA |
| 65 | NLpep33 (w/ Met) | N.A. | ATGGGAGTGACCGGCTGGCGGCTGAACAAGCGCATTAGCGCG |
| 66 | NLpep33 (w/ Met) | A.A. | MGVTGWRLNKRISA |
| 67 | NLpep34 (w/ Met) | N.A. | ATGGGAGTGACCGGCTGGCGGCTGACCAAGCGCATTAGCGCG |
| 68 | NLpep34 (w/ Met) | A.A. | MGVTGWRLTKRISA |
| 69 | NLpep35 (w/ Met) | N.A. | ATGGGAGTGACCGGCTGGCGGCTGTGCAAGAAGATTAGCGCG |
| 70 | NLpep35 (w/ Met) | A.A. | MGVTGWRLCKKISA |
| 71 | NLpep36 (w/ Met) | N.A. | ATGGGAGTGACCGGCTGGCGGCTGTGCAAGAACATTAGCGCG |
| 72 | NLpep36 (w/ Met) | A.A. | MGVTGWRLCKNISA |
| 73 | NLpep37 (w/ Met) | N.A. | ATGGGAGTGACCGGCTGGCGGCTGTGCAAGCGCGTGAGCGCG |
| 74 | NLpep37 (w/ Met) | A.A. | MGVTGWRLCKRVSA |
| 75 | NLpep38 (w/ Met) | N.A. | ATGGGAGTGACCGGCTGGCGGCTGTGCAAGCGCCAGAGCGCG |
| 76 | NLpep38 (w/ Met) | A.A. | MGVTGWRLCKRQSA |
| 77 | NLpep39 (w/ Met) | N.A. | ATGGGAGTGACCGGCTGGCGGCTGTGCAAGCGCGAGAGCGCG |
| 78 | NLpep39 (w/ Met) | A.A. | MGVTGWRLCKRESA |
| 79 | NLpep40 (w/ Met) | N.A. | ATGGGAGTGACCGGCTGGCGGCTGTGCAAGCGCCGGAGCGCG |
| 80 | NLpep40 (w/ Met) | A.A. | MGVTGWRLCKRRSA |
| 81 | NLpep41 (w/ Met) | N.A. | ATGGGAGTGACCGGCTGGCGGCTGTGCAAGCGCTTCAGCGCG |
| 82 | NLpep41 (w/ Met) | A.A. | MGVTGWRLCKRFSA |
| 83 | NLpep42 (w/ Met) | N.A. | ATGGGAGTGACCGGCTGGCGGCTGTGCAAGCGCATTAGCAAC |
| 84 | NLpep42 (w/ Met) | A.A. | MGVTGWRLCKRISN |
| 85 | NLpep43 (w/ Met) | N.A. | ATGGGAGTGACCGGCTGGCGGCTGTGCAAGCGCATTAGCACC |
| 86 | NLpep43 (w/ Met) | A.A. | MGVTGWRLCKRIST |
| 87 | NLpep44 (w/ Met) | N.A. | ATGGGAGTGACCGGCTGGCGGCTGTGCAAGCGCATTAGCCGG |
| 88 | NLpep44 (w/ Met) | A.A. | MGVTGWRLCKRISR |
| 89 | NLpep45 (w/ Met) | N.A. | ATGGGAGTGACCGGCTGGCGGCTGTGCAAGCGCATTAGCCTG |
| 90 | NLpep45 (w/ Met) | A.A. | MGVTGWRLCKRISL |
| 91 | NLpep46 (w/ Met) | N.A. | ATGGGAGTGACCGGCTGGCGGCTGTGCAAGCGCATTAGCGAG |
| 92 | NLpep46 (w/ Met) | A.A. | MGVTGWRLCKRISE |
| 93 | NLpep47 (w/ Met) | N.A. | ATGGGAGTGACCGGCTTCCGGCTGTGCAAGCGCATTAGCGCG |

TABLE 1-continued

Exemplary internal tag and/or structural complement peptide sequences

| SEQ ID NO. | PEPTIDE NO. | | POLYMER SEQUENCE |
|---|---|---|---|
| 94 | NLpep47 (w/ Met) | A.A. | MGVTGFRLCKRISA |
| 95 | NLpep48 (w/ Met) | N.A. | ATGGGAGTGACCGGCTACCGGCTGTGCAAGCGCATTAGCGCG |
| 96 | NLpep48 (w/ Met) | A.A. | MGVTGYRLCKRISA |
| 97 | NLpep49 (w/ Met) | N.A. | ATGGGAGTGACCGGCGAGCGGCTGTGCAAGCGCATTAGCGCG |
| 98 | NLpep49 (w/ Met) | A.A. | MGVTGERLCKRISA |
| 99 | NLpep50 (w/ Met) | N.A. | ATGCAGGTGACCGGCTGGCGGCTGTGCAAGCGCATTAGCGCG |
| 100 | NLpep50 (w/ Met) | A.A. | MQVTGWRLCKRISA |
| 101 | NLpep51 (w/ Met) | N.A. | ATGACCGTGACCGGCTGGCGGCTGTGCAAGCGCATTAGCGCG |
| 102 | NLpep51 (w/ Met) | A.A. | MTVTGWRLCKRISA |
| 103 | NLpep52 (w/ Met) | N.A. | ATGGGAGTGGAGGGCTGGCGGCTGTGCAAGCGCATTAGCGCG |
| 104 | NLpep52 (w/ Met) | A.A. | MGVEGWRLCKRISA |
| 105 | NLpep53 (w/ Met) | N.A. | ATGGGAGTGACCGGCTGGCGGCTGTTCAAGCGCATTAGCGCG |
| 106 | NLpep53 (w/ Met) | A.A. | MGVTGWRLFKRISA |
| 107 | NLpep54 (w/ Met) | N.A. | ATGGGAGTGACCGGCTGGCGGCTGTACAAGCGCATTAGCGCG |
| 108 | NLpep54 (w/ Met) | A.A. | MGVTGWRLYKRISA |
| 109 | NLpep55 (w/ Met) | N.A. | ATGGGAGTGACCGGCTGGCGGCTGAGCAAGCGCATTAGCGCG |
| 110 | NLpep55 (w/ Met) | A.A. | MGVTGWRLSKRISA |
| 111 | NLpep56 (w/ Met) | N.A. | ATGGGAGTGACCGGCTGGCGGCTGGGCAAGCGCATTAGCGCG |
| 112 | NLpep56 (w/ Met) | A.A. | MGVTGWRLHKRISA |
| 113 | NLpep57 (w/ Met) | N.A. | ATGGGAGTGACCGGCTGGCGGCTGATGAAGCGCATTAGCGCG |
| 114 | NLpep57 (w/ Met) | A.A. | MGVTGWRLMKRISA |
| 115 | NLpep58 (w/ Met) | N.A. | ATGGGAGTGACCGGCTGGCGGCTGGCCAAGCGCATTAGCGCG |
| 116 | NLpep58 (w/ Met) | A.A. | MGVTGWRLAKRISA |
| 117 | NLpep59 (w/ Met) | N.A. | ATGGGAGTGACCGGCTGGCGGCTGCAGAAGCGCATTAGCGCG |
| 118 | NLpep59 (w/ Met) | A.A. | MGVTGWRLQKRISA |
| 119 | NLpep60 (w/ Met) | N.A. | ATGGGAGTGACCGGCTGGCGGCTGCTGAAGCGCATTAGCGCG |
| 120 | NLpep60 (w/ Met) | A.A. | MGVTGWRLLKRISA |
| 121 | NLpep61 (w/ Met) | N.A. | ATGGGAGTGACCGGCTGGCGGCTGAAGAAGCGCATTAGCGCG |
| 122 | NLpep61 (w/ Met) | A.A. | MGVTGWRLKKRISA |
| 123 | NLpep62 (w/ Met) | N.A. | ATGAACCACACCGGCTGGCGGCTGAACAAGAAGGTGAGCAAC |
| 124 | NLpep62 (w/ Met) | A.A. | MNITGWRLNKKVSN |
| 125 | NLpep63 (w/ Met) | N.A. | ATGAACCACACCGGCTACCGGCTGAACAAGAAGGTGAGCAAC |
| 126 | NLpep63 (w/ Met) | A.A. | MNITGYRLNKKVSN |
| 127 | NLpep64 (w/ Met) | N.A. | ATGTGCGTGACCGGCTGGCGGCTGTTCAAGCGCATTAGCGCG |
| 128 | NLpep64 (w/ Met) | A.A. | MCVTGWRLFKRISA |
| 129 | NLpep65 (w/ Met) | N.A. | ATGCCCGTGACCGGCTGGCGGCTGTTCAAGCGCATTAGCGCG |
| 130 | NLpep65 (w/ Met) | A.A. | MPVTGWRLFKRISA |

TABLE 1-continued

Exemplary internal tag and/or structural complement peptide sequences

| SEQ ID NO. | PEPTIDE NO. | | POLYMER SEQUENCE |
|---|---|---|---|
| 131 | NLpep66 (w/ Met) | N.A. | ATGAACCACACCGGCTACCGGCTGTTCAAGAAGGTGAGCAAC |
| 132 | NLpep66 (w/ Met) | A.A. | MNITGYRLFKKVSN |
| 133 | NLpep67 (w/ Met) | N.A. | ATGAACGTGACCGGCTACCGGCTGTTCAAGAAGGTGAGCAAC |
| 134 | NLpep67 (w/ Met) | A.A. | MNVTGYRLFKKVSN |
| 135 | NLpep68 (w/ Met) | N.A. | ATGAACGTGACCGGCTGGCGGCTGTTCAAGAAGGTGAGCAAC |
| 136 | NLpep68 (w/ Met) | A.A. | MNVTGWRLFKKVSN |
| 137 | NLpep69 (w/ Met) | N.A. | ATGAACGTGACCGGCTGGCGGCTGTTCAAGAAGATTAGCAAC |
| 138 | NLpep69 (w/ Met) | A.A. | MNVTGWRLFKKISN |
| 139 | NLpep70 (w/ Met) | N.A. | ATGAACGTGACCGGCTGGCGGCTGTTCAAGCGCATTAGCAAC |
| 140 | NLpep70 (w/ Met) | A.A. | MNVTGWRLFKRISN |
| 141 | NLpep71 (w/ Met) | N.A. | ATGGGAGTGACCGGCTGGCGGCTGTTCAAGCGCATTAGCAAC |
| 142 | NLpep71 (w/ Met) | A.A. | MGVTGWRLFKRISN |
| 143 | NLpep72 (w/ Met) | N.A. | ATGAACGTGACCGGCTGGCGGCTGTTCGAACGCATTAGCAAC |
| 144 | NLpep72 (w/ Met) | A.A. | MNVTGWRLFLRISN |
| 145 | NLpep73 (w/ Met) | N.A. | ATGAACGTGACCGGCTGGCGGCTGTTCAAGCGCATTCTGAAC |
| 146 | NLpep73 (w/ Met) | A.A. | MNVTGWRLFKRILN |
| 147 | NLpep74 (w/ Met) | N.A. | ATGAACGTGACCGGCTGGCGGCTGTTCAAGCGCATTAGCGCG |
| 148 | NLpep74 (w/ Met) | A.A. | MNVTGWRLFKRISA |
| 149 | NLpep75 (w/ Met) | N.A. | ATGAACGTGACCGGCTGGCGGCTGTTCGAAAAGATTAGCAAC |
| 150 | NLpep75 (w/ Met) | A.A. | MNVTGWRLFLKISN |
| 151 | NLpep76 (w/ Met) | N.A. | ATGAACGTGAGCGGCTGGCGGCTGTTCGAAAAGATTAGCAAC |
| 152 | NLpep76 (w/ Met) | A.A. | MNVSGWRLFEKISN |
| 153 | NLpep77 (w/ Met) | N.A. | ATG-GTGACCGGCTGGCGGCTGTTCAAGAAGATTAGCAAC |
| 154 | NLpep77 (w/ Met) | A.A. | M-VTGWRLFKKISN |
| 155 | NLpep78 (w/ Met) | N.A. | ATGAACGTGAGCGGCTGGCGGCTGTTCAAGAAGATTAGCAAC |
| 156 | NLpep78 (w/ Met) | A.A. | MNVSGWRLFKKISN |
| 157 | NLpep79 (w/ Met) | N.A. | ATGAACGTGACCGGCTACCGGCTGTTCAAGAAGATTAGCAAC |
| 158 | NLpep79 (w/ Met) | A.A. | MNVTGYRLFKKISN |
| 159 | NLpep80 (w/ Met) | N.A. | ATGGTGAGCGGCTGGCGGCTGTTCAAGAAGATTAGCAAC |
| 160 | NLpep80 (w/ Met) | A.A. | MVSGWRLFKKISN |
| 161 | NLpep81 (w/ Met) | N.A. | ATGAGCGGCTGGCGGCTGTTCAAGAAGATTAGCAAC |
| 440 | NLpep81 (w/ Met) | A.A. | MSGWRLFKKISN |
| 163 | NLpep82 (w/ Met) | N.A. | ATGGGCTGGCGGCTGTTCAAGAAGATTAGCAAC |
| 164 | NLpep82 (w/ Met) | A.A. | MGWRLFKKISN |
| 165 | NLpep83 (w/ Met) | N.A. | ATGAACGTGAGCGGCTGGCGGCTGTTCAAGAAGATTAGC |
| 166 | NLpep83 (w/ Met) | A.A. | MNVSGWRLFKKIS |
| 167 | NLpep84 (w/ Met) | N.A. | ATGAACGTGAGCGGCTGGCGGCTGTTCAAGAAGATT |

TABLE 1-continued

Exemplary internal tag and/or structural complement peptide sequences

| SEQ ID NO. | PEPTIDE NO. | | POLYMER SEQUENCE |
|---|---|---|---|
| 168 | NLpep84 (w/ Met) | A.A. | MNVSGWRLFKKI |
| 169 | NLpep85 (w/ Met) | N.A. | ATGAACGTGAGCGGCTGGCGGCTGTTCAAGAAG |
| 170 | NLpep85 (w/ Met) | A.A. | MNVSGWRLFKK |
| 171 | NLpep86 (w/ Met) | N.A. | ATGGTGAGCGGCTGGCGGCTGTTCAAGAAGATTAGC |
| 172 | NLpep86 (w/ Met) | A.A. | MVSGWRLFKKIS |
| 173 | NLpep87 (w/ Met) | N.A. | ATGAGCGGCTGGCGGCTGTTCAAGAAGATT |
| 174 | NLpep87 (w/ Met) | A.A. | MSGWRLFKKI |
| 175 | NLpep88 (w/ Met) | N.A. | ATGAACGTGAGCGGCTGGGGCCTGTTCAAGAAGATTAGCAAC |
| 176 | NLpep88 (w/ Met) | A.A. | MNVSGWGLFKKISN |
| 177 | NLpep89 (w/ Met) | N.A. | ATGCCCGTGAGCGGCTGGCGGCTGTTCAAGAAGATTAGCAAC |
| 178 | NLpep89 (w/ Met) | A.A. | MPVSGWRLFKKISN |
| 179 | NLpep90 (w/ Met) | N.A. | ATGAACCCCGTGAGCGGCTGGCGGCTGTTCAAGAAGATTAGCAAC |
| 180 | NLpep90 (w/ Met) | A.A. | MNPVSGWRLFKKISN |
| 181 | NLpep91 (w/ Met) | N.A. | ATGATCAACCCCGTGAGCGGCTGGCGGCTGTTCAAGAAGATTAGCAAC |
| 182 | NLpep91 (w/ Met) | A.A. | MINPVSGWRLFKKISN |
| 183 | NLpep92 (w/ Met) | N.A. | ATGACCATCAACCCCGTGAGCGGCTGGCGGCTGTTCAAGAAGATTAGCAAC |
| 184 | NLpep92 (w/ Met) | A.A. | MTINPVSGWRLFKKISN |
| 185 | NLpep93 (w/ Met) | N.A. | ATGGTGACCATCAACCCCGTGAGCGGCTGGCGGCTGTTCAAGAAGATTAGCAAC |
| 186 | NLpep93 (w/ Met) | A.A. | MVTINPVSGWRLFKKISN |
| 187 | NLpep94 (w/ Met) | N.A. | ATGCGGGTGACCATCAACCCCGTGAGCGGCTGGCGGCTGTTCAAGAAGATTAGCAAC |
| 188 | NLpep94 (w/ Met) | A.A. | MRVTINPVSGWRLFKKISN |
| 189 | NLpep95 (w/ Met) | N.A. | ATGAGCGGCTGGCGGCTGCTGAAGAAGATT |
| 190 | NLpep95 (w/ Met) | A.A. | MSGWRLLKKI |
| 191 | NLpep96 (w/ Met) | N.A. | ATGACCGGCTACCGGCTGCTGAAGAAGATT |
| 192 | NLpep96 (w/ Met) | A.A. | MTGYRLLKKI |
| 193 | NLpep97 (w/ Met) | N.A. | ATGAGCGGCTGGCGGCTGTTCAAGAAG |
| 194 | NLpep97 (w/ Met) | A.A. | MSGWRLFKK |
| 195 | NLpep98 (w/ Met) | N.A. | ATGGTGACCGGCTACCGGCTGTTCAAGAAGATTAGC |
| 196 | NLpep98 (w/ Met) | A.A. | MVTGYRLFKKIS |
| 197 | NLpep99 (w/ Met) | N.A. | ATGGTGACCGGCTACCGGCTGTTCGAGAAGATTAGC |
| 198 | NLpep99 (w/ Met) | A.A. | MVTGYRLFEKIS |
| 199 | NLpep100 (w/ Met) | N.A. | ATGGTGACCGGCTACCGGCTGTTCGAGCAGATTAGC |
| 200 | NLpep100 (w/ Met) | A.A. | MVTGYRLFEQIS |
| 201 | NLpep101 (w/ Met) | N.A. | ATGGTGACCGGCTACCGGCTGTTCGAGAAGGAGAGC |
| 202 | NLpep101 (w/ Met) | A.A. | MVTGYRLFEKES |

TABLE 1-continued

Exemplary internal tag and/or structural complement peptide sequences

| SEQ ID NO. | PEPTIDE NO. | | POLYMER SEQUENCE |
|---|---|---|---|
| 203 | NLpep102 (w/ Met) | N.A. | ATGGTGACCGGCTACCGGCTGTTCGAGCAGGAGAGC |
| 204 | NLpep102 (w/ Met) | A.A. | MVTGYRLFEQES |
| 205 | NLpep103 (w/ Met) | N.A. | ATGGTGACCGGCTACCGGCTGTTCGAGCAGGAGCTG |
| 206 | NLpep103 (w/ Met) | A.A. | MVTGYRLFEQEL |
| 207 | NLpep104 (w/ Met) | N.A. | ATGGTGGAGGGCTACCGGCTGTTCGAGAAGATTAGC |
| 208 | NLpep104 (w/ Met) | A.A. | MVEGYRLFEKIS |
| 209 | NLpep105 (w/ Met) | N.A. | ATGGTGGAGGGCTACCGGCTGTTCGAGCAGATTAGC |
| 210 | NLpep105 (w/ Met) | A.A. | MVEGYRLFEQIS |
| 211 | NLpep106 (w/ Met) | N.A. | ATGGTGGAGGGCTACCGGCTGTTCGAGAAGGAGAGC |
| 212 | NLpep106 (w/ Met) | A.A. | MVEGYRLFEKES |
| 213 | NLpep107 (w/ Met) | N.A. | ATGGTGGAGGGCTACCGGCTGTTCGAGCAGGAGAGC |
| 214 | NLpep107 (w/ Met) | A.A. | MVEGYRLFEQES |
| 215 | NLpep108 (w/ Met) | N.A. | ATGGTGGAGGGCTACCGGCTGTTCGAGCAGGAGCTG |
| 216 | NLpep108 (w/ Met) | A.A. | MVEGYRLFEQEL |
| 217 | NLpep109 (w/ Met) | N.A. | ATGATTAGCGGCTGGCGGCTGATGAAGAACATTAGC |
| 218 | NLpep109 (w/ Met) | A.A. | MISGWRLMKNIS |
| 219 | NLpep110 (w/ Met) | N.A. | ATGGTGGAGGGCTACCGGCTGTTCAAGAAGATTAGC |
| 220 | NLpep110 (w/ Met) | A.A. | MVEGYRLFKKIS |
| 221 | NLpep2 (w/o Met) | N.A. | GACGTGACCGGCTGGCGGCTGTGCGAACGCATTCTGGCG |
| 222 | NLpep2 (w/o Met) | A.A. | DVTGWRLCERILA |
| 223 | NLpep3 (w/o Met) | N.A. | GGAGTGACCGCCTGGCGGCTGTGCGAACGCATTCTGGCG |
| 224 | NLpep3 (w/o Met) | A.A. | GVTAWRLCERILA |
| 225 | NLpep4 (w/o Met) | N.A. | GGAGTGACCGGCTGGCGGCTGTGCAAGCGCATTCTGGCG |
| 226 | NLpep4 (w/o Met) | A.A. | GVTGWRLCKRILA |
| 227 | NLpepS (w/o Met) | N.A. | GGAGTGACCGGCTGGCGGCTGTGCGAACGCATTAGCGCG |
| 228 | NLpepS (w/o Met) | A.A. | GVTGWRLCERISA |
| 229 | NLpep6 (w/o Met) | N.A. | GACGTGACCGGCTGGCGGCTGTGCAAGCGCATTAGCGCG |
| 230 | NLpep6 (w/o Met) | A.A. | DVTGWRLCKRISA |
| 231 | NLpep7 (w/o Met) | N.A. | GACGTGACCGGCTGGCGGCTGTGCAAGCGCATTCTGGCG |
| 232 | NLpep7 (w/o Met) | A.A. | DVTGWRLCKRILA |
| 233 | NLpep8 (w/o Met) | N.A. | GACGTGACCGGCTGGCGGCTGTGCGAACGCATTAGCGCG |
| 234 | NLpep8 (w/o Met) | A.A. | DVTGWRLCERISA |
| 235 | NLpep9 (w/o Met) | N.A. | GGAGTGACCGGCTGGCGGCTGTGCAAGCGCATTAGCGCG |
| 236 | NLpep9 (w/o Met) | A.A. | GVTGWRLCKRISA |
| 237 | NLpep10 (w/o Met) | N.A. | GGAGTGACCGGCTGGCGGCTGAACGAACGCATTCTGGCG |
| 238 | NLpep10 (w/o Met) | A.A. | GVTGWRLNERILA |
| 239 | NLpep11 (w/o Met) | N.A. | GGAGTGACCGGCTGGCGGCTGCAGGAACGCATTCTGGCG |

TABLE 1-continued

Exemplary internal tag and/or structural complement peptide sequences

| SEQ ID NO. | PEPTIDE NO. | | POLYMER SEQUENCE |
|---|---|---|---|
| 240 | NLpep11 (w/o Met) | A.A. | GVTGWRLQERILA |
| 241 | NLpep12 (w/o Met) | N.A. | GGAGTGACCGGCTGGCGGCTGAAGAAGCGCCGGAGCCGG |
| 242 | NLpep12 (w/o Met) | A.A. | GVTGWRLKKRRSR |
| 243 | NLpep13 (w/o Met) | N.A. | AACGTGACCGGCTGGCGGCTGTGCAAGCGCATTAGCGCG |
| 244 | NLpep13 (w/o Met) | A.A. | NVTGWRLCKRISA |
| 245 | NLpep14 (w/o Met) | N.A. | AGCGTGACCGGCTGGCGGCTGTGCAAGCGCATTAGCGCG |
| 246 | NLpep14 (w/o Met) | A.A. | SVTGWRLCKRISA |
| 247 | NLpep15 (w/o Met) | N.A. | GAGGTGACCGGCTGGCGGCTGTGCAAGCGCATTAGCGCG |
| 248 | NLpep15 (w/o Met) | A.A. | EVTGWRLCKRISA |
| 249 | NLpep16 (w/o Met) | N.A. | GGCGTGACCGGCTGGCGGCTGTGCAAGCGCATTAGCGCG |
| 250 | NLpep16 (w/o Met) | A.A. | HVTGWRLCKRISA |
| 251 | NLpep17 (w/o Met) | N.A. | GGACACACCGGCTGGCGGCTGTGCAAGCGCATTAGCGCG |
| 252 | NLpep17 (w/o Met) | A.A. | GITGWRLCKRISA |
| 253 | NLpep18 (w/o Met) | N.A. | GGAGCCACCGGCTGGCGGCTGTGCAAGCGCATTAGCGCG |
| 254 | NLpep18 (w/o Met) | A.A. | GATGWRLCKRISA |
| 255 | NLpep19 (w/o Met) | N.A. | GGAAAGACCGGCTGGCGGCTGTGCAAGCGCATTAGCGCG |
| 256 | NLpep19 (w/o Met) | A.A. | GKTGWRLCKRISA |
| 257 | NLpep20 (w/o Met) | N.A. | GGACAGACCGGCTGGCGGCTGTGCAAGCGCATTAGCGCG |
| 258 | NLpep20 (w/o Met) | A.A. | GQTGWRLCKRISA |
| 259 | NLpep21 (w/o Met) | N.A. | GGAAGCACCGGCTGGCGGCTGTGCAAGCGCATTAGCGCG |
| 260 | NLpep21 (w/o Met) | A.A. | GSTGWRLCKRISA |
| 261 | NLpep22 (w/o Met) | N.A. | GGAGTGGTGGGCTGGCGGCTGTGCAAGCGCATTAGCGCG |
| 262 | NLpep22 (w/o Met) | A.A. | GVVGWRLCKRISA |
| 263 | NLpep23 (w/o Met) | N.A. | GGAGTGAAGGGCTGGCGGCTGTGCAAGCGCATTAGCGCG |
| 264 | NLpep23 (w/o Met) | A.A. | GVKGWRLCKRISA |
| 265 | NLpep24 (w/o Met) | N.A. | GGAGTGCAGGGCTGGCGGCTGTGCAAGCGCATTAGCGCG |
| 266 | NLpep24 (w/o Met) | A.A. | GVQGWRLCKRISA |
| 267 | NLpep25 (w/o Met) | N.A. | GGAGTGACCGGCACCCGGCTGTGCAAGCGCATTAGCGCG |
| 268 | NLpep25 (w/o Met) | A.A. | GVTGTRLCKRISA |
| 269 | NLpep26 (w/o Met) | N.A. | GGAGTGACCGGCAAGCGGCTGTGCAAGCGCATTAGCGCG |
| 270 | NLpep26 (w/o Met) | A.A. | GVTGKRLCKRISA |
| 271 | NLpep27 (w/o Met) | N.A. | GGAGTGACCGGCGTGCGGCTGTGCAAGCGCATTAGCGCG |
| 272 | NLpep27 (w/o Met) | A.A. | GVTGVRLCKRISA |
| 273 | NLpep28 (w/o Met) | N.A. | GGAGTGACCGGCTGGCGGCACTGCAAGCGCATTAGCGCG |
| 274 | NLpep28 (w/o Met) | A.A. | GVTGWRICKRISA |
| 275 | NLpep29 (w/o Met) | N.A. | GGAGTGACCGGCTGGCGGGTGTGCAAGCGCATTAGCGCG |
| 276 | NLpep29 (w/o Met) | A.A. | GVTGWRVCKRISA |

TABLE 1-continued

Exemplary internal tag and/or structural complement peptide sequences

| SEQ ID NO. | PEPTIDE NO. | | POLYMER SEQUENCE |
|---|---|---|---|
| 277 | NLpep30 (w/o Met) | N.A. | GGAGTGACCGGCTGGCGGACCTGCAAGCGCATTAGCGCG |
| 278 | NLpep30 (w/o Met) | A.A. | GVTGWRTCKRISA |
| 279 | NLpep31 (w/o Met) | N.A. | GGAGTGACCGGCTGGCGGTACTGCAAGCGCATTAGCGCG |
| 280 | NLpep31 (w/o Met) | A.A. | GVTGWRYCKRISA |
| 281 | NLpep32 (w/o Met) | N.A. | GGAGTGACCGGCTGGCGGAAGTGCAAGCGCATTAGCGCG |
| 282 | NLpep32 (w/o Met) | A.A. | GVTGWRKCKRISA |
| 283 | NLpep33 (w/o Met) | N.A. | GGAGTGACCGGCTGGCGGCTGAACAAGCGCATTAGCGCG |
| 284 | NLpep33 (w/o Met) | A.A. | GVTGWRLNKRISA |
| 285 | NLpep34 (w/o Met) | N.A. | GGAGTGACCGGCTGGCGGCTGACCAAGCGCATTAGCGCG |
| 286 | NLpep34 (w/o Met) | A.A. | GVTGWRLTKRISA |
| 287 | NLpep35 (w/o Met) | N.A. | GGAGTGACCGGCTGGCGGCTGTGCAAGAAGATTAGCGCG |
| 288 | NLpep35 (w/o Met) | A.A. | GVTGWRLCKKISA |
| 289 | NLpep36 (w/o Met) | N.A. | GGAGTGACCGGCTGGCGGCTGTGCAAGAACATTAGCGCG |
| 290 | NLpep36 (w/o Met) | A.A. | GVTGWRLCKNISA |
| 291 | NLpep37 (w/o Met) | N.A. | GGAGTGACCGGCTGGCGGCTGTGCAAGCGCGTGAGCGCG |
| 292 | NLpep37 (w/o Met) | A.A. | GVTGWRLCKRVSA |
| 293 | NLpep38 (w/o Met) | N.A. | GGAGTGACCGGCTGGCGGCTGTGCAAGCGCCAGAGCGCG |
| 294 | NLpep38 (w/o Met) | A.A. | GVTGWRLCKRQSA |
| 295 | NLpep39 (w/o Met) | N.A. | GGAGTGACCGGCTGGCGGCTGTGCAAGCGCGAGAGCGCG |
| 296 | NLpep39 (w/o Met) | A.A. | GVTGWRLCKRESA |
| 297 | NLpep40 (w/o Met) | N.A. | GGAGTGACCGGCTGGCGGCTGTGCAAGCGCCGGAGCGCG |
| 298 | NLpep40 (w/o Met) | A.A. | GVTGWRLCKRRSA |
| 299 | NLpep41 (w/o Met) | N.A. | GGAGTGACCGGCTGGCGGCTGTGCAAGCGCTTCAGCGCG |
| 300 | NLpep41 (w/o Met) | A.A. | GVTGWRLCKRFSA |
| 301 | NLpep42 (w/o Met) | N.A. | GGAGTGACCGGCTGGCGGCTGTGCAAGCGCATTAGCAAC |
| 302 | NLpep42 (w/o Met) | A.A. | GVTGWRLCKRISN |
| 303 | NLpep43 (w/o Met) | N.A. | GGAGTGACCGGCTGGCGGCTGTGCAAGCGCATTAGCACC |
| 304 | NLpep43 (w/o Met) | A.A. | GVTGWRLCKRIST |
| 305 | NLpep44 (w/o Met) | N.A. | GGAGTGACCGGCTGGCGGCTGTGCAAGCGCATTAGCCGG |
| 306 | NLpep44 (w/o Met) | A.A. | GVTGWRLCKRISR |
| 307 | NLpep45 (w/o Met) | N.A. | GGAGTGACCGGCTGGCGGCTGTGCAAGCGCATTAGCCTG |
| 308 | NLpep45 (w/o Met) | A.A. | GVTGWRLCKRISL |
| 309 | NLpep46 (w/o Met) | N.A. | GGAGTGACCGGCTGGCGGCTGTGCAAGCGCATTAGCGAG |
| 310 | NLpep46 (w/o Met) | A.A. | GVTGWRLCKRISE |
| 311 | NLpep47 (w/o Met) | N.A. | GGAGTGACCGGCTTCCGGCTGTGCAAGCGCATTAGCGCG |
| 312 | NLpep47 (w/o Met) | A.A. | GVTGFRLCKRISA |
| 313 | NLpep48 (w/o Met) | N.A. | GGAGTGACCGGCTACCGGCTGTGCAAGCGCATTAGCGCG |

TABLE 1-continued

Exemplary internal tag and/or structural complement peptide sequences

| SEQ ID NO. | PEPTIDE NO. | | POLYMER SEQUENCE |
|---|---|---|---|
| 314 | NLpep48 (w/o Met) | A.A. | GVTGYRLCKRISA |
| 315 | NLpep49 (w/o Met) | N.A. | GGAGTGACCGGCGAGCGGCTGTGCAAGCGCATTAGCGCG |
| 316 | NLpep49 (w/o Met) | A.A. | GVTGERLCKRISA |
| 317 | NLpep50 (w/o Met) | N.A. | CAGGTGACCGGCTGGCGGCTGTGCAAGCGCATTAGCGCG |
| 318 | NLpep50 (w/o Met) | A.A. | QVTGWRLCKRISA |
| 319 | NLpep51 (w/o Met) | N.A. | ACCGTGACCGGCTGGCGGCTGTGCAAGCGCATTAGCGCG |
| 320 | NLpep51 (w/o Met) | A.A. | TVTGWRLCKRISA |
| 321 | NLpep52 (w/o Met) | N.A. | GGAGTGGAGGGCTGGCGGCTGTGCAAGCGCATTAGCGCG |
| 322 | NLpep52 (w/o Met) | A.A. | GVEGWRLCKRISA |
| 323 | NLpep53 (w/o Met) | N.A. | GGAGTGACCGGCTGGCGGCTGTTCAAGCGCATTAGCGCG |
| 324 | NLpep53 (w/o Met) | A.A. | GVTGWRLFKRISA |
| 325 | NLpep54 (w/o Met) | N.A. | GGAGTGACCGGCTGGCGGCTGTACAAGCGCATTAGCGCG |
| 326 | NLpep54 (w/o Met) | A.A. | GVTGWRLYKRISA |
| 327 | NLpep55 (w/o Met) | N.A. | GGAGTGACCGGCTGGCGGCTGAGCAAGCGCATTAGCGCG |
| 328 | NLpep55 (w/o Met) | A.A. | GVTGWRLSKRISA |
| 329 | NLpep56 (w/o Met) | N.A. | GGAGTGACCGGCTGGCGGCTGGGCAAGCGCATTAGCGCG |
| 330 | NLpep56 (w/o Met) | A.A. | GVTGWRLHKRISA |
| 331 | NLpep57 (w/o Met) | N.A. | GGAGTGACCGGCTGGCGGCTGATGAAGCGCATTAGCGCG |
| 332 | NLpep57 (w/o Met) | A.A. | GVTGWRLMKRISA |
| 333 | NLpep58 (w/o Met) | N.A. | GGAGTGACCGGCTGGCGGCTGGCCAAGCGCATTAGCGCG |
| 334 | NLpep58 (w/o Met) | A.A. | GVTGWRLAKRISA |
| 335 | NLpep59 (w/o Met) | N.A. | GGAGTGACCGGCTGGCGGCTGCAGAAGCGCATTAGCGCG |
| 336 | NLpep59 (w/o Met) | A.A. | GVTGWRLQKRISA |
| 337 | NLpep60 (w/o Met) | N.A. | GGAGTGACCGGCTGGCGGCTGCTGAAGCGCATTAGCGCG |
| 338 | NLpep60 (w/o Met) | A.A. | GVTGWRLLKRISA |
| 339 | NLpep61 (w/o Met) | N.A. | GGAGTGACCGGCTGGCGGCTGAAGAAGCGCATTAGCGCG |
| 340 | NLpep61 (w/o Met) | A.A. | GVTGWRLKKRISA |
| 341 | NLpep62 (w/o Met) | N.A. | AACCACACCGGCTGGCGGCTGAACAAGAAGGTGAGCAAC |
| 342 | NLpep62 (w/o Met) | A.A. | NITGWRLNKKVSN |
| 343 | NLpep63 (w/o Met) | N.A. | AACCACACCGGCTACCGGCTGAACAAGAAGGTGAGCAAC |
| 344 | NLpep63 (w/o Met) | A.A. | NITGYRLNKKVSN |
| 345 | NLpep64 (w/o Met) | N.A. | TGCGTGACCGGCTGGCGGCTGTTCAAGCGCATTAGCGCG |
| 346 | NLpep64 (w/o Met) | A.A. | CVTGWRLFKRISA |
| 347 | NLpep65 (w/o Met) | N.A. | CCCGTGACCGGCTGGCGGCTGTTCAAGCGCATTAGCGCG |
| 348 | NLpep65 (w/o Met) | A.A. | PVTGWRLFKRISA |
| 349 | NLpep66 (w/o Met) | N.A. | AACCACACCGGCTACCGGCTGTTCAAGAAGGTGAGCAAC |
| 350 | NLpep66 (w/o Met) | A.A. | NITGYRLFKKVSN |

TABLE 1-continued

Exemplary internal tag and/or structural complement peptide sequences

| SEQ ID NO. | PEPTIDE NO. | | POLYMER SEQUENCE |
|---|---|---|---|
| 351 | NLpep67 (w/o Met) | N.A. | AACGTGACCGGCTACCGGCTGTTCAAGAAGGTGAGCAAC |
| 352 | NLpep67 (w/o Met) | A.A. | NVTGYRLFKKVSN |
| 353 | NLpep68 (w/o Met) | N.A. | AACGTGACCGGCTGGCGGCTGTTCAAGAAGGTGAGCAAC |
| 354 | NLpep68 (w/o Met) | A.A. | NVTGWRLFKKVSN |
| 355 | NLpep69 (w/o Met) | N.A. | AACGTGACCGGCTGGCGGCTGTTCAAGAAGATTAGCAAC |
| 356 | NLpep69 (w/o Met) | A.A. | NVTGWRLFKKISN |
| 357 | NLpep70 (w/o Met) | N.A. | AACGTGACCGGCTGGCGGCTGTTCAAGCGCATTAGCAAC |
| 358 | NLpep70 (w/o Met) | A.A. | NVTGWRLFKRISN |
| 359 | NLpep71 (w/o Met) | N.A. | GGAGTGACCGGCTGGCGGCTGTTCAAGCGCATTAGCAAC |
| 360 | NLpep71 (w/o Met) | A.A. | GVTGWRLFKRISN |
| 361 | NLpep72 (w/o Met) | N.A. | AACGTGACCGGCTGGCGGCTGTTCGAACGCATTAGCAAC |
| 362 | NLpep72 (w/o Met) | A.A. | NVTGWRLFLRISN |
| 363 | NLpep73 (w/o Met) | N.A. | AACGTGACCGGCTGGCGGCTGTTCAAGCGCATTCTGAAC |
| 364 | NLpep73 (w/o Met) | A.A. | NVTGWRLFKRILN |
| 365 | NLpep74 (w/o Met) | N.A. | AACGTGACCGGCTGGCGGCTGTTCAAGCGCATTAGCGCG |
| 366 | NLpep74 (w/o Met) | A.A. | NVTGWRLFKRISA |
| 367 | NLpep75 (w/o Met) | N.A. | AACGTGACCGGCTGGCGGCTGTTCGAAAAGATTAGCAAC |
| 368 | NLpep75 (w/o Met) | A.A. | NVTGWRLFEKISN |
| 369 | NLpep76 (w/o Met) | N.A. | AACGTGAGCGGCTGGCGGCTGTTCGAAAAGATTAGCAAC |
| 370 | NLpep76 (w/o Met) | A.A. | NVSGWRLFEKISN |
| 371 | NLpep77 (w/o Met) | N.A. | GTGACCGGCTGGCGGCTGTTCAAGAAGATTAGCAAC |
| 372 | NLpep77 (w/o Met) | A.A. | VTGWRLFKKISN |
| 373 | NLpep78 (w/o Met) | N.A. | AACGTGAGCGGCTGGCGGCTGTTCAAGAAGATTAGCAAC |
| 374 | NLpep78 (w/o Met) | A.A. | NVSGWRLFKKISN |
| 375 | NLpep79 (w/o Met) | N.A. | AACGTGACCGGCTACCGGCTGTTCAAGAAGATTAGCAAC |
| 376 | NLpep79 (w/o Met) | A.A. | NVTGYRLFKKISN |
| 377 | NLpep80 (w/o Met) | N.A. | GTGAGCGGCTGGCGGCTGTTCAAGAAGATTAGCAAC |
| 378 | NLpep80 (w/o Met) | A.A. | VSGWRLFKKISN |
| 379 | NLpep81 (w/o Met) | N.A. | AGCGGCTGGCGGCTGTTCAAGAAGATTAGCAAC |
| 380 | NLpep81 (w/o Met) | A.A. | SGWRLFKKISN |
| 381 | NLpep82 (w/o Met) | N.A. | GGCTGGCGGCTGTTCAAGAAGATTAGCAAC |
| 382 | NLpep82 (w/o Met) | A.A. | GWRLFKKISN |
| 383 | NLpep83 (w/o Met) | N.A. | AACGTGAGCGGCTGGCGGCTGTTCAAGAAGATTAGC |
| 384 | NLpep83 (w/o Met) | A.A. | NVSGWRLFKKIS |
| 385 | NLpep84 (w/o Met) | N.A. | AACGTGAGCGGCTGGCGGCTGTTCAAGAAGATT |
| 386 | NLpep84 (w/o Met) | A.A. | NVSGWRLFKKI |
| 387 | NLpep85 (w/o Met) | N.A. | AACGTGAGCGGCTGGCGGCTGTTCAAGAAG |

TABLE 1-continued

Exemplary internal tag and/or structural complement peptide sequences

| SEQ ID NO. | PEPTIDE NO. | | POLYMER SEQUENCE |
|---|---|---|---|
| 388 | NLpep85 (w/o Met) | A.A. | NVSGWRLFKK |
| 389 | NLpep86 (w/o Met) | N.A. | GTGAGCGGCTGGCGGCTGTTCAAGAAGATTAGC |
| 390 | NLpep86 (w/o Met) | A.A. | VSGWRLFKKIS |
| 391 | NLpep87 (w/o Met) | N.A. | AGCGGCTGGCGGCTGTTCAAGAAGATT |
| 392 | NLpep87 (w/o Met) | A.A. | SGWRLFKKI |
| 393 | NLpep88 (w/o Met) | N.A. | AACGTGAGCGGCTGGGGCCTGTTCAAGAAGATTAGCAAC |
| 394 | NLpep88 (w/o Met) | A.A. | NVSGWGLFKKISN |
| 395 | NLpep89 (w/o Met) | N.A. | CCCGTGAGCGGCTGGCGGCTGTTCAAGAAGATTAGCAAC |
| 396 | NLpep89 (w/o Met) | A.A. | PVSGWRLFKKISN |
| 397 | NLpep90 (w/o Met) | N.A. | AACCCCGTGAGCGGCTGGCGGCTGTTCAAGAAGATTAGCAAC |
| 398 | NLpep90 (w/o Met) | A.A. | NPVSGWRLFKKISN |
| 399 | NLpep91 (w/o Met) | N.A. | ATCAACCCCGTGAGCGGCTGGCGGCTGTTCAAGAAGATTAGCAAC |
| 400 | NLpep91 (w/o Met) | A.A. | INPVSGWRLFKKISN |
| 401 | NLpep92 (w/o Met) | N.A. | ACCATCAACCCCGTGAGCGGCTGGCGGCTGTTCAAGAAGATTAGCAAC |
| 402 | NLpep92 (w/o Met) | A.A. | TINPVSGWRLFKKISN |
| 403 | NLpep93 (w/o Met) | N.A. | GTGACCATCAACCCCGTGAGCGGCTGGCGGCTGTTCAAGAAGATTAGCAAC |
| 404 | NLpep93 (w/o Met) | A.A. | VTINPVSGWRLFKKISN |
| 405 | NLpep94 (w/o Met) | N.A. | CGGGTGACCATCAACCCCGTGAGCGGCTGGCGGCTGTTCAAGAAGATTAGCAAC |
| 406 | NLpep94 (w/o Met) | A.A. | RVTINPVSGWRLFKKISN |
| 407 | NLpep95 (w/o Met) | N.A. | AGCGGCTGGCGGCTGCTGAAGAAGATT |
| 408 | NLpep95 (w/o Met) | A.A. | SGWRLLKKI |
| 409 | NLpep96 (w/o Met) | N.A. | ACCGGCTACCGGCTGCTGAAGAAGATT |
| 410 | NLpep96 (w/o Met) | A.A. | TGYRLLKKI |
| 411 | NLpep97 (w/o Met) | N.A. | AGCGGCTGGCGGCTGTTCAAGAAG |
| 412 | NLpep97 (w/o Met) | A.A. | SGWRLFKK |
| 413 | NLpep98 (w/o Met) | N.A. | GTGACCGGCTACCGGCTGTTCAAGAAGATTAGC |
| 414 | NLpep98 (w/o Met) | A.A. | VTGYRLFKKIS |
| 415 | NLpep99 (w/o Met) | N.A. | GTGACCGGCTACCGGCTGTTCGAGAAGATTAGC |
| 416 | NLpep99 (w/o Met) | A.A. | VTGYRLFEKIS |
| 417 | NLpep100 (w/o Met) | N.A. | GTGACCGGCTACCGGCTGTTCGAGCAGATTAGC |
| 418 | NLpep100 (w/o Met) | A.A. | VTGYRLFEQIS |
| 419 | NLpep101 (w/o Met) | N.A. | GTGACCGGCTACCGGCTGTTCGAGAAGGAGAGC |
| 420 | NLpep101 (w/o Met) | A.A. | VTGYRLFEKES |
| 421 | NLpep102 (w/o Met) | N.A. | GTGACCGGCTACCGGCTGTTCGAGCAGGAGAGC |
| 422 | NLpep102 (w/o Met) | A.A. | VTGYRLFEQES |

TABLE 1-continued

Exemplary internal tag and/or structural complement peptide sequences

| SEQ ID NO. | PEPTIDE NO. | POLYMER | SEQUENCE |
|---|---|---|---|
| 423 | NLpep103 (w/o Met) | N.A. | GTGACCGGCTACCGGCTGTTCGAGCAGGAGCTG |
| 424 | NLpep103 (w/o Met) | A.A. | VTGYRLFEQEL |
| 425 | NLpep104 (w/o Met) | N.A. | GTGGAGGGCTACCGGCTGTTCGAGAAGATTAGC |
| 426 | NLpep104 (w/o Met) | A.A. | VEGYRLFEKIS |
| 427 | NLpep105 (w/o Met) | N.A. | GTGGAGGGCTACCGGCTGTTCGAGCAGATTAGC |
| 428 | NLpep105 (w/o Met) | A.A. | VEGYRLFEQIS |
| 429 | NLpep106 (w/o Met) | N.A. | GTGGAGGGCTACCGGCTGTTCGAGAAGGAGAGC |
| 430 | NLpep106 (w/o Met) | A.A. | VEGYRLFEKES |
| 431 | NLpep107 (w/o Met) | N.A. | GTGGAGGGCTACCGGCTGTTCGAGCAGGAGAGC |
| 432 | NLpep107 (w/o Met) | A.A. | VEGYRLFEQES |
| 433 | NLpep108 (w/o Met) | N.A. | GTGGAGGGCTACCGGCTGTTCGAGCAGGAGCTG |
| 434 | NLpep108 (w/o Met) | A.A. | VEGYRLFEQEL |
| 435 | NLpep109 (w/o Met) | N.A. | ATTAGCGGCTGGCGGCTGATGAAGAACATTAGC |
| 436 | NLpep109 (w/o Met) | A.A. | ISGWRLMKNIS |
| 437 | NLpep110 (w/o Met) | N.A. | GTGGAGGGCTACCGGCTGTTCAAGAAGATTAGC |
| 438 | NLpep110 (w/o Met) | A.A. | VEGYRLFKKIS |
| 2162 | NLpep111 (w/ Met) | N.A. | ATGGTGACCGGCTACCGGCTGTTCGAGGAGATCAGC |
| 2163 | NLpep111 (w/ Met) | A.A. | MVTGYRLFEEIS |
| 2164 | NLpep112 (w/ Met) | N.A. | ATGGTGACCGGCTACCGGCTGTTCGAGGAGGCCAGC |
| 2165 | NLpep112 (w/ Met) | A.A. | MVTGYRLFEEAS |
| 2166 | NLpep113 (w/ Met) | N.A. | ATGGTGACCGGCTACCGGCTGTTCGAGGAGGAGAGC |
| 2167 | NLpep113 (w/ Met) | A.A. | MVTGYRLFEEES |
| 2168 | NLpep114 (w/ Met) | N.A. | ATGGTGACCGGCTACCGGCTGTTCGAGGAGATCCTG |
| 2169 | NLpep114 (w/ Met) | A.A. | MVTGYRLFEEIL |
| 2170 | NLpep115 (w/ Met) | N.A. | ATGGTGACCGGCTACCGGCTGTTCGAGGAGGCCCTG |
| 2171 | NLpep115 (w/ Met) | A.A. | MVTGYRLFEEAL |
| 2172 | NLpep116 (w/ Met) | N.A. | ATGGTGACCGGCTACCGGCTGTTCGAGGAGGAGCTG |
| 2173 | NLpep116 (w/ Met) | A.A. | MVTGYRLFEEEL |
| 2174 | NLpep117 (w/ Met) | N.A. | ATGGTGGAGGGCTACCGGCTGTTCGAGGAGATCAGC |
| 2175 | NLpep117 (w/ Met) | A.A. | MVEGYRLFEEIS |
| 2176 | NLpep118 (w/ Met) | N.A. | ATGGTGGAGGGCTACCGGCTGTTCGAGGAGGCCAGC |
| 2177 | NLpep118 (w/ Met) | A.A. | MVEGYRLFEEAS |
| 2178 | NLpep119 (w/ Met) | N.A. | ATGGTGGAGGGCTACCGGCTGTTCGAGGAGGAGAGC |
| 2179 | NLpep119 (w/ Met) | A.A. | MVEGYRLFEEES |
| 2180 | NLpep120 (w/ Met) | N.A. | ATGGTGGAGGGCTACCGGCTGTTCGAGGAGATCCTG |
| 2181 | NLpep120 (w/ Met) | A.A. | MVEGYRLFEEIL |
| 2182 | NLpep121 (w/ Met) | N.A. | ATGGTGGAGGGCTACCGGCTGTTCGAGGAGGCCCTG |

TABLE 1-continued

Exemplary internal tag and/or structural complement peptide sequences

| SEQ ID NO. | PEPTIDE NO. | | POLYMER SEQUENCE |
|---|---|---|---|
| 2183 | NLpep121 (w/ Met) | A.A. | MVEGYRLFEEAL |
| 2184 | NLpep122 (w/ Met) | N.A. | ATGGTGGAGGGCTACCGGCTGTTCGAGGAGGAGCTG |
| 2185 | NLpep122 (w/ Met) | A.A. | MVEGYRLFEEEL |
| 2186 | NLpep123 (w/ Met) | N.A. | ATGGTGACCGGCTACCGGCTGTTCAAGAAGATCCTG |
| 2187 | NLpep123 (w/ Met) | A.A. | MVTGYRLFKKIL |
| 2188 | NLpep124 (w/ Met) | N.A. | ATGGTGACCGGCTACCGGCTGATGAAGAAGATCCTG |
| 2189 | NLpep124 (w/ Met) | A.A. | MVTGYRLMKKIL |
| 2190 | NLpep125 (w/ Met) | N.A. | ATGGTGACCGGCTACCGGCTGCACAAGAAGATCCTG |
| 2191 | NLpep125 (w/ Met) | A.A. | MVTGYRLHKKIL |
| 2192 | NLpep126 (w/ Met) | N.A. | ATGGTGACCGGCTACCGGCTGCTGAAGAAGATCCTG |
| 2193 | NLpep126 (w/ Met) | A.A. | MVTGYRLLKKIL |
| 2194 | NLpep127 (w/ Met) | N.A. | ATGGTGACCGGCTACCGGCTGAGCAAGAAGATCCTG |
| 2195 | NLpep127 (w/ Met) | A.A. | MVTGYRLSKKIL |
| 2196 | NLpep128 (w/ Met) | N.A. | ATGGTGACCGGCTACCGGCTGTTCGAGAAGATCCTG |
| 2197 | NLpep128 (w/ Met) | A.A. | MVTGYRLFEKIL |
| 2198 | NLpep129(w/ Met) | N.A. | ATGGTGACCGGCTACCGGCTGATGGAGAAGATCCTG |
| 2199 | NLpep129(w/ Met) | A.A. | MVTGYRLMEKIL |
| 2200 | NLpep130 (w/ Met) | N.A. | ATGGTGACCGGCTACCGGCTGCACGAGAAGATCCTG |
| 2201 | NLpep130 (w/ Met) | A.A. | MVTGYRLHEKIL |
| 2202 | NLpep131 (w/ Met) | N.A. | ATGGTGACCGGCTACCGGCTGCTGGAGAAGATCCTG |
| 2203 | NLpep131 (w/ Met) | A.A. | MVTGYRLLEKIL |
| 2204 | NLpep132 (w/ Met) | N.A. | ATGGTGACCGGCTACCGGCTGAGCGAGAAGATCCTG |
| 2205 | NLpep132 (w/ Met) | A.A. | MVTGYRLSEKIL |
| 2206 | NLpep133 (w/ Met) | N.A. | ATGGTGACCGGCTACCGGCTGATGGAGGAGATCCTG |
| 2207 | NLpep133 (w/ Met) | A.A. | MVTGYRLMEEIL |
| 2208 | NLpep134(w/ Met) | N.A. | ATGGTGACCGGCTACCGGCTGCACGAGGAGATCCTG |
| 2209 | NLpep134 (w/ Met) | A.A. | MVTGYRLHEEIL |
| 2210 | NLpep135 (w/ Met) | N.A. | ATGGTGACCGGCTACCGGCTGCTGGAGGAGATCCTG |
| 2211 | NLpep135 (w/ Met) | A.A. | MVTGYRLLEEIL |
| 2212 | NLpep136 (w/ Met) | N.A. | ATGGTGACCGGCTACCGGCTGAGCGAGGAGATCCTG |
| 2213 | NLpep136 (w/ Met) | A.A. | MVTGYRLSEEIL |
| 2214 | NLpep137(w/ Met) | N.A. | ATGGTGAGCGGCTACCGGCTGTTCGAGGAGATCCTG |
| 2215 | NLpep137 (w/ Met) | A.A. | MVSGYRLFEEIL |
| 2216 | NLpep138(w/ Met) | N.A. | ATGGTGACCGGCTGGCGGCTGTTCGAGGAGATCCTG |
| 2217 | NLpep138 (w/ Met) | A.A. | MVTGWRLFEEIL |
| 2218 | NLpep139 (w/ Met) | N.A. | ATGGTGAGCGGCTGGCGGCTGTTCGAGGAGATCCTG |
| 2219 | NLpep139 (w/ Met) | A.A. | MVSGWRLFEEIL |

TABLE 1-continued

Exemplary internal tag and/or structural complement peptide sequences

| SEQ ID NO. | PEPTIDE NO. | | POLYMER SEQUENCE |
|---|---|---|---|
| 2220 | NLpep140 (w/ Met) | N.A. | ATGAACGTGACCGGCTACCGGCTGTTCGAGGAGATCCTG |
| 2221 | NLpep140 (w/ Met) | A.A. | MNVTGYRLFEEIL |
| 2222 | NLpep141 (w/ Met) | N.A. | ATGGTGACCGGCTACCGGCTGTTCGAGGAGATCCTGAAC |
| 2223 | NLpep141 (w/ Met) | A.A. | MVTGYRLFEEILN |
| 2224 | NLpep142 (w/ Met) | N.A. | ATGAACGTGACCGGCTACCGGCTGTTCGAGGAGATCCTGAAC |
| 2225 | NLpep142 (w/ Met) | A.A. | MNVTGYRLFEEILN |
| 2226 | NLpep143 (w/ Met) | N.A. | ATGGTGACCGGCTACCGGCTGTTCGAGGAGATC |
| 2227 | NLpep143 (w/ Met) | A.A. | MVTGYRLFEEI |
| 2228 | NLpep144 (w/ Met) | N.A. | ATGGTGACCGGCTACCGGCTGTTCCAGAAGATCAGC |
| 2229 | NLpep144 (w/ Met) | A.A. | MVTGYRLFQKIS |
| 2230 | NLpep145 (w/ Met) | N.A. | ATGGTGACCGGCTACCGGCTGTTCAAGAAGATCAGCAAC |
| 2231 | NLpep145 (w/ Met) | A.A. | MVTGYRLFKKISN |
| 2232 | NLpep146 (w/ Met) | N.A. | ATGGTGACCGGCTACCGGCTGTTCAAGAAGATCAGC |
| 2233 | NLpep146 (w/ Met) | A.A. | MVTGYRLFKKIS |
| 2234 | NLpep147 (w/ Met) | A.A. | MVSGWRLFKKISA |
| 2235 | NLpep148 (w/ Met) | A.A. | MGVSGWRLFKKIS |
| 2236 | NLpep149 (w/ Met) | A.A. | MSVSGWRLFKKISN |
| 2237 | NLpep150 (w/ Met) | A.A. | MSVSGWRLFKKISA |
| 2238 | NLpep151 (w/ Met) | A.A. | MNSVSGWRLFKKISA |
| 2239 | NLpep152 (w/ Met) | A.A. | MNSVSGWRLFKKISN |
| 2240 | NLpep153 (w/ Met) | A.A. | MSNVSGWRLFKKIS |
| 2241 | NLpep154 (w/ Met) | A.A. | MSGVSGWRLFKKIS |
| 2242 | NLpep155 (w/ Met) | A.A. | MNSNVSGWRLFKKIS |
| 2243 | NLpep156 (w/ Met) | A.A. | MNSGVSGWRLFKKIS |
| 2244 | NLpep157 (w/ Met) | A.A. | MSVSGWRLFKKIS |
| 2245 | NLpep158 (w/ Met) | A.A. | MNSVSGWRLFKKIS |
| 2246 | NLpep159 (w/ Met) | A.A. | MSNVSGWRLFKKISN |
| 2247 | NLpep160 (w/ Met) | A.A. | MNSNVSGWRLFKKISN |
| 2248 | NLpep161 (w/ Met) | A.A. | MGWRLFKK |
| 2249 | NLpep162 (w/Met) | A.A. | MGWALFKK |
| 2250 | NLpep163 (w/ Met) | A.A. | MVTGWALFEEIL |
| 2251 | NLpep164 (w/ Met) | A.A. | MVTGYALFQEIL |
| 2252 | NLpep165 (w/ Met) | A.A. | MVTGYALFEQIL |
| 2253 | NLpep166 (w/ Met) | A.A. | MVTGYALFEEIL |
| 2254 | NLpep167 (w/ Met) | N.A. | ATGGTGTCCGGCTGGGCACTGTTCAAGAAAATTTCC |
| 2255 | NLpep167 (w/ Met) | A.A. | MVSGWALFKKIS |
| 2256 | NLpep168 (w/ Met) | A.A. | MVSGWKLFKKIS |

TABLE 1-continued

Exemplary internal tag and/or structural complement peptide sequences

| SEQ ID NO. | PEPTIDE NO. | | POLYMER SEQUENCE |
|---|---|---|---|
| 2257 | NLpep169 (w/ Met) | N.A. | ATGGTGTCCGGCTGGCAGCTGTTCAAGAAAATTTCC |
| 2258 | NLpep169 (w/ Met) | A.A. | MVSGWQLFKKIS |
| 2259 | NLpep170 (w/ Met) | A.A. | MVSGWELFKKIS |
| 2260 | NLpep171 (w/ Met) | N.A. | ATGGTGTCCGGCTGGCTGCTGTTCAAGAAAATTTCC |
| 2261 | NLpep171 (w/ Met) | A.A. | MVSGWLLFKKIS |
| 2262 | NLpep172 (w/ Met) | N.A. | ATGGTGTCCGGCTGGGTGCTGTTCAAGAAAATTTCC |
| 2263 | NLpep172 (w/ Met) | A.A. | MVSGWVLFKKIS |
| 2264 | NLpep111 (w/o Met) | N.A. | GTGACCGGCTACCGGCTGTTCGAGGAGATCAGC |
| 2265 | NLpep111 (w/o Met) | A.A. | VTGYRLFEEIS |
| 2266 | NLpep112 (w/o Met) | N.A. | GTGACCGGCTACCGGCTGTTCGAGGAGGCCAGC |
| 2267 | NLpep112 (w/o Met) | A.A. | VTGYRLFEEAS |
| 2268 | NLpep113 (w/o Met) | N.A. | GTGACCGGCTACCGGCTGTTCGAGGAGGAGAGC |
| 2269 | NLpep113 (w/o Met) | A.A. | VTGYRLFEEES |
| 2270 | NLpep114 (w/o Met) | N.A. | GTGACCGGCTACCGGCTGTTCGAGGAGATCCTG |
| 2271 | NLpep114 (w/o Met) | A.A. | VTGYRLFEEIL |
| 2272 | NLpep115 (w/o Met) | N.A. | GTGACCGGCTACCGGCTGTTCGAGGAGGCCCTG |
| 2273 | NLpep115 (w/o Met) | A.A. | VTGYRLFEEAL |
| 2274 | NLpep116 (w/o Met) | N.A. | GTGACCGGCTACCGGCTGTTCGAGGAGGAGCTG |
| 2275 | NLpep116 (w/o Met) | A.A. | VTGYRLFEEEL |
| 2276 | NLpep117 (w/o Met) | N.A. | GTGGAGGGCTACCGGCTGTTCGAGGAGATCAGC |
| 2277 | NLpep117 (w/o Met) | A.A. | VEGYRLFEEIS |
| 2278 | NLpep118 (w/o Met) | N.A. | GTGGAGGGCTACCGGCTGTTCGAGGAGGCCAGC |
| 2279 | NLpep118 (w/o Met) | A.A. | VEGYRLFEEAS |
| 2280 | NLpep119 (w/o Met) | N.A. | GTGGAGGGCTACCGGCTGTTCGAGGAGGAGAGC |
| 2281 | NLpep119 (w/o Met) | A.A. | VEGYRLFEEES |
| 2282 | NLpep120 (w/o Met) | N.A. | GTGGAGGGCTACCGGCTGTTCGAGGAGATCCTG |
| 2283 | NLpep120 (w/o Met) | A.A. | VEGYRLFEEIL |
| 2284 | NLpep121 (w/o Met) | N.A. | GTGGAGGGCTACCGGCTGTTCGAGGAGGCCCTG |
| 2285 | NLpep121 (w/o Met) | A.A. | VEGYRLFEEAL |
| 2286 | NLpep122 (w/o Met) | N.A. | GTGGAGGGCTACCGGCTGTTCGAGGAGGAGCTG |
| 2287 | NLpep122 (w/o Met) | A.A. | VEGYRLFEEEL |
| 2288 | NLpep123 (w/o Met) | N.A. | GTGACCGGCTACCGGCTGTTCAAGAAGATCCTG |
| 2289 | NLpep123 (w/o Met) | A.A. | VTGYRLFKKIL |
| 2290 | NLpep124 (w/o Met) | N.A. | GTGACCGGCTACCGGCTGATGAAGAAGATCCTG |
| 2291 | NLpep124 (w/o Met) | A.A. | VTGYRLMKKIL |
| 2292 | NLpep125 (w/o Met) | N.A. | GTGACCGGCTACCGGCTGCACAAGAAGATCCTG |
| 2293 | NLpep125 (w/o Met) | A.A. | VTGYRLHKKIL |

TABLE 1-continued

Exemplary internal tag and/or structural complement peptide sequences

| SEQ ID NO. | PEPTIDE NO. | | POLYMER SEQUENCE |
|---|---|---|---|
| 2294 | NLpep126 (w/o Met) | N.A. | GTGACCGGCTACCGGCTGCTGAAGAAGATCCTG |
| 2295 | NLpep126 (w/o Met) | A.A. | VTGYRLLKKIL |
| 2296 | NLpep127 (w/o Met) | N.A. | GTGACCGGCTACCGGCTGAGCAAGAAGATCCTG |
| 2297 | NLpep127 (w/o Met) | A.A. | VTGYRLSKKIL |
| 2298 | NLpep128 (w/o Met) | N.A. | GTGACCGGCTACCGGCTGTTCGAGAAGATCCTG |
| 2299 | NLpep128 (w/o Met) | A.A. | VTGYRLFEKIL |
| 2300 | NLpep129 (w/o Met) | N.A. | GTGACCGGCTACCGGCTGATGGAGAAGATCCTG |
| 2301 | NLpep129 (w/o Met) | A.A. | VTGYRLMEKIL |
| 2302 | NLpep130 (w/o Met) | N.A. | GTGACCGGCTACCGGCTGCACGAGAAGATCCTG |
| 2303 | NLpep130 (w/o Met) | A.A. | VTGYRLHEKIL |
| 2304 | NLpep131 (w/o Met) | N.A. | GTGACCGGCTACCGGCTGCTGGAGAAGATCCTG |
| 2305 | NLpep131 (w/o Met) | A.A. | VTGYRLLEKIL |
| 2306 | NLpep132 (w/o Met) | N.A. | GTGACCGGCTACCGGCTGAGCGAGAAGATCCTG |
| 2307 | NLpep132 (w/o Met) | A.A. | VTGYRLSEKIL |
| 2308 | NLpep133 (w/o Met) | N.A. | GTGACCGGCTACCGGCTGATGGAGGAGATCCTG |
| 2309 | NLpep133 (w/o Met) | A.A. | VTGYRLMEEIL |
| 2310 | NLpep134 (w/o Met) | N.A. | GTGACCGGCTACCGGCTGCACGAGGAGATCCTG |
| 2311 | NLpep134 (w/o Met) | A.A. | VTGYRLHEEIL |
| 2312 | NLpep135 (w/o Met) | N.A. | GTGACCGGCTACCGGCTGCTGGAGGAGATCCTG |
| 2313 | NLpep135 (w/o Met) | A.A. | VTGYRLLEEIL |
| 2314 | NLpep136 (w/o Met) | N.A. | GTGACCGGCTACCGGCTGAGCGAGGAGATCCTG |
| 2315 | NLpep136 (w/o Met) | A.A. | VTGYRLSEEIL |
| 2316 | NLpep137 (w/o Met) | N.A. | GTGAGCGGCTACCGGCTGTTCGAGGAGATCCTG |
| 2317 | NLpep137 (w/o Met) | A.A. | VSGYRLFEEIL |
| 2318 | NLpep138 (w/o Met) | N.A. | GTGACCGGCTGGCGGCTGTTCGAGGAGATCCTG |
| 2319 | NLpep138 (w/o Met) | A.A. | VTGWRLFEEIL |
| 2320 | NLpep139 (w/o Met) | N.A. | GTGAGCGGCTGGCGGCTGTTCGAGGAGATCCTG |
| 2321 | NLpep139 (w/o Met) | A.A. | VSGWRLFEEIL |
| 2322 | NLpep140 (w/o Met) | N.A. | AACGTGACCGGCTACCGGCTGTTCGAGGAGATCCTG |
| 2323 | NLpep140 (w/o Met) | A.A. | NVTGYRLFEEIL |
| 2324 | NLpep141 (w/o Met) | N.A. | GTGACCGGCTACCGGCTGTTCGAGGAGATCCTGAAC |
| 2325 | NLpep141 (w/o Met) | A.A. | VTGYRLFEEILN |
| 2326 | NLpep142 (w/o Met) | N.A. | AACGTGACCGGCTACCGGCTGTTCGAGGAGATCCTGAAC |
| 2327 | NLpep142 (w/o Met) | A.A. | NVTGYRLFEEILN |
| 2328 | NLpep143 (w/o Met) | N.A. | GTGACCGGCTACCGGCTGTTCGAGGAGATC |
| 2329 | NLpep143 (w/o Met) | A.A. | VTGYRLFEEI |
| 2330 | NLpep144 (w/o Met) | N.A. | GTGACCGGCTACCGGCTGTTCCAGAAGATCAGC |

TABLE 1-continued

Exemplary internal tag and/or structural complement peptide sequences

| SEQ ID NO. | PEPTIDE NO. | | POLYMER SEQUENCE |
|---|---|---|---|
| 2331 | NLpep144 (w/o Met) | A.A. | VTGYRLFQKIS |
| 2332 | NLpep145 (w/o Met) | N.A. | GTGACCGGCTACCGGCTGTTCAAGAAGATCAGCAAC |
| 2333 | NLpep145 (w/o Met) | A.A. | VTGYRLFKKISN |
| 2334 | NLpep146 (w/o Met) | N.A. | GTGACCGGCTACCGGCTGTTCAAGAAGATCAGC |
| 2335 | NLpep146 (w/o Met) | A.A. | VTGYRLFKKIS |
| 2336 | NLpep147 (w/o Met) | A.A. | VSGWRLFKKISA |
| 2337 | NLpep148 (w/o Met) | A.A. | GVSGWRLFKKIS |
| 2338 | NLpep149 (w/o Met) | A.A. | SVSGWRLFKKISN |
| 2339 | NLpep150 (w/o Met) | A.A. | SVSGWRLFKKISA |
| 2340 | NLpep151 (w/o Met) | A.A. | NSVSGWRLFKKISA |
| 2341 | NLpep152 (w/o Met) | A.A. | NSVSGWRLFKKISN |
| 2342 | NLpep153 (w/o Met) | A.A. | SNVSGWRLFKKIS |
| 2343 | NLpep154 (w/o Met) | A.A. | SGVSGWRLFKKIS |
| 2344 | NLpep155 (w/o Met) | A.A. | NSNVSGWRLFKKIS |
| 2345 | NLpep156 (w/o Met) | A.A. | NSGVSGWRLFKKIS |
| 2346 | NLpep157 (w/o Met) | A.A. | SVSGWRLFKKIS |
| 2347 | NLpep158 (w/o Met) | A.A. | NSVSGWRLFKKIS |
| 2348 | NLpep159 (w/o Met) | A.A. | SNVSGWRLFKKISN |
| 2349 | NLpep160 (w/o Met) | A.A. | NSNVSGWRLFKKISN |
| 2350 | NLpep161 (w/o Met) | A.A. | GWRLFKK |
| 2351 | NLpep162 (w/o Met) | A.A. | GWALFKK |
| 2352 | NLpep163 (w/o Met) | A.A. | VTGWALFEEIL |
| 2353 | NLpep164 (w/o Met) | A.A. | VTGYALFQEIL |
| 2354 | NLpep165 (w/o Met) | A.A. | VTGYALFEQIL |
| 2355 | NLpep166 (w/o Met) | A.A. | VTGYALFEEIL |
| 2356 | NLpep167 (w/o Met) | N.A. | GTGTCCGGCTGGGCACTGTTCAAGAAAATTTCC |
| 2357 | NLpep167 (w/o Met) | A.A. | VSGWALFKKIS |
| 2358 | NLpep168 (w/o Met) | A.A. | VSGWKLFKKIS |
| 2359 | NLpep169 (w/o Met) | N.A. | GTGTCCGGCTGGCAGCTGTTCAAGAAAATTTCC |
| 2360 | NLpep169 (w/o Met) | A.A. | VSGWQLFKKIS |
| 2361 | NLpep170 (w/o Met) | A.A. | VSGWELFKKIS |
| 2362 | NLpep171 (w/o Met) | N.A. | GTGTCCGGCTGGCTGCTGTTCAAGAAAATTTCC |
| 2363 | NLpep171 (w/o Met) | A.A. | VSGWLLFKKIS |
| 2364 | NLpep172 (w/o Met) | N.A. | GTGTCCGGCTGGGTGCTGTTCAAGAAAATTTCC |
| 2365 | NLpep172 (w/o Met) | A.A. | VSGWVLFKKIS |

In certain embodiments, a peptide from Table 1 is provided (e.g., as an internal tag or a structural complement of an internal tag). In some embodiments, an internal tag or a structural complement comprise a single amino acid difference from GVTGWRLCKRILA (SEQ ID NO: 2) and/or any of the peptides listed in Table 1. In some embodiments, an internal tag or a structural complement comprises two or more (e.g., 2, 3, 4, 5, 6, 7, 8, 9, 10, etc.) amino acid differences from GVTGWRLCKRILA (SEQ ID NO: 2) and/or any of the peptides listed in Table 1. In some embodiments, an internal tag or a structural complement is provided comprising one of the amino acid sequences of SEQ ID NOS: 3-438 and 2162-2365. In some embodiments, an internal tag or a structural complement is provided comprising one of the amino acid sequences of SEQ ID NOS: 3-438 and 2162-2365 with one or more additions, substitutions, and/or deletions. In some embodiments, an internal tag, a structural complement, or a portion thereof comprises greater than 70% sequence identity (e.g., 71%, 75%, 80%, 85%, 90%, 95%, 99%) with one or more of the amino acid sequences of SEQ ID NOS: 3-438 and 2162-2365. In some embodiments, nucleic acids are provided comprising one of the nucleic acid coding sequences of SEQ ID NOS: 3-438 and 2162-2365. In some embodiments, nucleic acids are provided comprising one of the nucleic acid sequences of SEQ ID NOS: 3-438 and 2162-2365 with one or more additions, substitutions, and/or deletions. In some embodiments, a nucleic acid or a portion thereof comprises greater than 70% sequence identity (e.g., 71%, 75%, 80%, 85%, 90%, 95%, 99%) with one or more of the nucleic acid sequence of SEQ ID NOS: 3-438 and 2162-2365. In some embodiments, nucleic acids are provided that code for one of the amino acid sequences of SEQ ID NOS: 3-438 and 2162-2365. In some embodiments, nucleic acids are provided that code for one of the amino acid sequences of SEQ ID NOS: 3-438 and 2162-2365 with one or more additions, substitutions, and/or deletions. In some embodiments, a nucleic acid is provided that codes for an amino acid with greater than 70% sequence identity (e.g., 71%, 75%, 80%, 85%, 90%, 95%, 99%) with one or more of the amino acid sequences of SEQ ID NOS: 3-438 and 2162-2365.

In certain embodiments, a nucleic acid from Table 1 is provided. In some embodiments, a nucleic acid encoding a peptide from Table 1 is provided. In some embodiments, a nucleic acid encoding a peptide from Table 1 inserted into another polypeptide sequence is provided. In some embodiments, a nucleic acid of the present invention codes for a peptide that comprises a single amino acid difference from MGVTGWRLCERILA (SEQ ID NO: 2) and/or any of the peptides listed in Table 1 (e.g., inserted into a polypeptide sequence). In some embodiments, nucleic acids code for peptides comprising two or more (e.g., 2, 3, 4, 5, 6, 7, 8, 9, 10, etc.) amino acid differences from MGVTGWRLCERILA (SEQ ID NO: 2) and/or any of the peptides listed in Table 1 (e.g., inserted into a polypeptide sequence). In some embodiments, nucleic acids are provided comprising the sequence of one of the nucleic acids in Table 1 (e.g., inserted into a polypeptide sequence). In some embodiments, nucleic acids are provided comprising one of the nucleic acids of Table 1 with one or more additions, substitutions, and/or deletions. In some embodiments, a nucleic acid or a portion thereof comprises greater than 70% sequence identity (e.g., 71%, 75%, 80%, 85%, 90%, 95%, 99%) with one or more of the nucleic acids of Table 1 (e.g., inserted into a polypeptide sequence).

In some embodiments, internal tags and/or a structural complements of an internal tag that find use in embodiments described herein include polypeptides with one or more amino acid substitutions, deletions, or additions from SEQ ID NO: 440. In some embodiments provided herein is an internal tag or a structural complement of an internal tag comprising an amino acid sequence of Table 2, and/or nucleic acids comprising the nucleic acid sequences of Table 2.

TABLE 2

Exemplary internal tag and/or structural complement polypeptide sequences

| SEQ ID NO | Polymer ID | SEQ ID NO | Poly. ID | SEQ ID NO | Poly. ID |
| --- | --- | --- | --- | --- | --- |
| 441 | N.A. R11N | 727 | N.A. 5A2 + V58P | 1013 | N.A. 5P D6 (−152-157) |
| 442 | A.A R11N | 728 | A.A 5A2 + V58P | 1014 | A.A 5P D6 (−152-157) |
| 443 | N.A. T13I | 729 | N.A. 5A2 + V58Q | 1015 | N.A. 5P D7 (−151-157) |
| 444 | A.A T13I | 730 | A.A 5A2 + V58Q | 1016 | A.A 5P D7 (−151-157) |
| 445 | N.A. G15S | 731 | N.A. 5A2 + V58R | 1017 | N.A. 5P + F31A |
| 446 | A.A G15S | 732 | A.A 5A2 + V58R | 1018 | A.A 5P + F31A |
| 447 | N.A. L18Q | 733 | N.A. 5A2 + V58S | 1019 | N.A. 5P + F31C |
| 448 | A.A L18Q | 734 | A.A 5A2 + V58S | 1020 | A.A 5P + F31C |
| 449 | N.A. Q20K | 735 | N.A. 5A2 + V58T | 1021 | N.A. 5P + F31D |
| 450 | A.A Q20K | 736 | A.A 5A2 + V58T | 1022 | A.A 5P + F31D |
| 451 | N.A. V27M | 737 | N.A. 5A2 + V58W | 1023 | N.A. 5P + F31E |
| 452 | A.A V27M | 738 | A.A 5A2 + V58W | 1024 | A.A 5P + F31E |
| 453 | N.A. F31I | 739 | N.A. 5A2 + V58Y | 1025 | N.A. 5P + F31G |
| 454 | A.A F31I | 740 | A.A 5A2 + V58Y | 1026 | A.A 5P + F31G |
| 455 | N.A. F31L | 741 | N.A. 5A2 + A67C | 1027 | N.A. 5P + F31H |
| 456 | A.A F31L | 742 | A.A 5A2 + A67C | 1028 | A.A 5P + F31H |
| 457 | N.A. F31V | 743 | N.A. 5A2 + A67D | 1029 | N.A. 5P + F31I |
| 458 | A.A F31V | 744 | A.A 5A2 + A67D | 1030 | A.A 5P + F31I |
| 459 | N.A. Q32R | 745 | N.A. 5A2 + A67E | 1031 | N.A. 5P + F31K |
| 460 | A.A Q32R | 746 | A.A 5A2 + A67E | 1032 | A.A 5P + F31K |
| 461 | N.A. N33K | 747 | N.A. 5A2 + A67F | 1033 | N.A. 5P + F31L |
| 462 | A.A N33K | 748 | A.A 5A2 + A67F | 1034 | A.A 5P + F31L |
| 463 | N.A. N33R | 749 | N.A. 5A2 + A67G | 1035 | N.A. 5P + F31M |
| 464 | A.A N33R | 750 | A.A 5A2 + A67G | 1036 | A.A 5P + F31M |
| 465 | N.A. I56N | 751 | N.A. 5A2 + A67H | 1037 | N.A. 5P + F31N |
| 466 | A.A I56N | 752 | A.A 5A2 + A67H | 1038 | A.A 5P + F31N |

TABLE 2-continued

Exemplary internal tag and/or structural complement polypeptide sequences

| SEQ ID NO | Polymer ID | SEQ ID NO | Poly. ID | SEQ ID NO | Poly. ID |
|---|---|---|---|---|---|
| 467 | N.A. V58A | 753 | N.A. 5A2 + A67I | 1039 | N.A. 5P + F31P |
| 468 | A.A V58A | 754 | A.A 5A2 + A67I | 1040 | A.A 5P + F31P |
| 469 | N.A. I59T | 755 | N.A. 5A2 + A67K | 1041 | N.A. 5P + F31Q |
| 470 | A.A I59T | 756 | A.A 5A2 + A67K | 1042 | A.A 5P + F31Q |
| 471 | N.A. G67S | 757 | N.A. 5A2 + A67L | 1043 | N.A. 5P + F31R |
| 472 | A.A G67S | 758 | A.A 5A2 + A67L | 1044 | A.A 5P + F31R |
| 473 | N.A. G67D | 759 | N.A. 5A2 + A67M | 1045 | N.A. 5P + F31S |
| 474 | A.A G67D | 760 | A.A 5A2 + A67M | 1046 | A.A 5P + F31S |
| 475 | N.A. K75E | 761 | N.A. 5A2 + A67N | 1047 | N.A. 5P + F31T |
| 476 | A.A K75E | 762 | A.A 5A2 + A67N | 1048 | A.A 5P + F31T |
| 477 | N.A. M106V | 763 | N.A. 5A2 + A67P | 1049 | N.A. 5P + F31V |
| 478 | A.A M106V | 764 | A.A 5A2 + A67P | 1050 | A.A 5P + F31V |
| 479 | N.A. M106I | 765 | N.A. 5A2 + A67Q | 1051 | N.A. 5P + F31W |
| 480 | A.A M106I | 766 | A.A 5A2 + A67Q | 1052 | A.A 5P + F31W |
| 481 | N.A. D108N | 767 | N.A. 5A2 + A67R | 1053 | N.A. 5P + F31Y |
| 482 | A.A D108N | 768 | A.A 5A2 + A67R | 1054 | A.A 5P + F31Y |
| 483 | N.A. R112Q | 769 | N.A. 5A2 + A67S | 1055 | N.A. 5P + L46A |
| 484 | A.A R112Q | 770 | A.A 5A2 + A67S | 1056 | A.A 5P + L46A |
| 485 | N.A. N144T | 771 | N.A. 5A2 + A67T | 1057 | N.A. 5P + L46C |
| 486 | A.A N144T | 772 | A.A 5A2 + A67T | 1058 | A.A 5P + L46C |
| 487 | N.A. L149M | 773 | N.A. 5A2 + A67V | 1059 | N.A. 5P + L46D |
| 488 | A.A L149M | 774 | A.A 5A2 + A67V | 1060 | A.A 5P + L46D |
| 489 | N.A. N156D | 775 | N.A. 5A2 + A67W | 1061 | N.A. 5P + L46E |
| 490 | A.A N156D | 776 | A.A 5A2 + A67W | 1062 | A.A 5P + L46E |
| 491 | N.A. N156S | 777 | N.A. 5A2 + A67Y | 1063 | N.A. 5P + L46F |
| 492 | A.A N156S | 778 | A.A 5A2 + A67Y | 1064 | A.A 5P + L46F |
| 493 | N.A. V157D | 779 | N.A. 5A2 + M106A | 1065 | N.A. 5P + L46G |
| 494 | A.A V157D | 780 | A.A 5A2 + M106A | 1066 | A.A 5P + L46G |
| 495 | N.A. V157S | 781 | N.A. 5A2 + M106C | 1067 | N.A. 5P + L46H |
| 496 | A.A V157S | 782 | A.A 5A2 + M106C | 1068 | A.A 5P + L46H |
| 497 | N.A. G8A | 783 | N.A. 5A2 + M106D | 1069 | N.A. 5P + L46I |
| 498 | A.A G8A | 784 | A.A 5A2 + M106D | 1070 | A.A 5P + L46I |
| 499 | N.A. G15A | 785 | N.A. 5A2 + M106E | 1071 | N.A. 5P + L46K |
| 500 | A.A G15A | 786 | A.A 5A2 + M106E | 1072 | A.A 5P + L46K |
| 501 | N.A. G25A | 787 | N.A. 5A2 + M106F | 1073 | N.A. 5P + L46M |
| 502 | A.A G25A | 788 | A.A 5A2 + M106F | 1074 | A.A 5P + L46M |
| 503 | N.A. G26A | 789 | N.A. 5A2 + M106G | 1075 | N.A. 5P + L46N |
| 504 | A.A G26A | 790 | A.A 5A2 + M106G | 1076 | A.A 5P + L46N |
| 505 | N.A. G35A | 791 | N.A. 5A2 + M106H | 1077 | N.A. 5P + L46P |
| 506 | A.A G35A | 792 | A.A 5A2 + M106H | 1078 | A.A 5P + L46P |
| 507 | N.A. G48A | 793 | N.A. 5A2 + M106I | 1079 | N.A. 5P + L46Q |
| 508 | A.A G48A | 794 | A.A 5A2 + M106I | 1080 | A.A 5P + L46Q |
| 509 | N.A. G51A | 795 | N.A. 5A2 + M106K | 1081 | N.A. 5P + L46R |
| 510 | A.A G51A | 796 | A.A 5A2 + M106K | 1082 | A.A 5P + L46R |
| 511 | N.A. G64A | 797 | N.A. 5A2 + M106L | 1083 | N.A. 5P + L46S |
| 512 | A.A G64A | 798 | A.A 5A2 + M106L | 1084 | A.A 5P + L46S |
| 513 | N.A. G67A | 799 | N.A. 5A2 + M106N | 1085 | N.A. 5P + L46T |
| 514 | A.A G67A | 800 | A.A 5A2 + M106N | 1086 | A.A 5P + L46T |
| 515 | N.A. G71A | 801 | N.A. 5A2 + M106P | 1087 | N.A. 5P + L46V |
| 516 | A.A G71A | 802 | A.A 5A2 + M106P | 1088 | A.A 5P + L46V |
| 517 | N.A. G95A | 803 | N.A. 5A2 + M106Q | 1089 | N.A. 5P + L46W |
| 518 | A.A G95A | 804 | A.A 5A2 + M106Q | 1090 | A.A 5P + L46W |
| 519 | N.A. G101A | 805 | N.A. 5A2 + M106R | 1091 | N.A. 5P + L46Y |
| 520 | A.A G101A | 806 | A.A 5A2 + M106R | 1092 | A.A 5P + L46Y |
| 521 | N.A. G111A | 807 | N.A. 5A2 + M106S | 1093 | N.A. 5P + N108A |
| 522 | A.A G111A | 808 | A.A 5A2 + M106S | 1094 | A.A 5P + N108A |
| 523 | N.A. G116A | 809 | N.A. 5A2 + M106T | 1095 | N.A. 5P + N108C |
| 524 | A.A G116A | 810 | A.A 5A2 + M106T | 1096 | A.A 5P + N108C |
| 525 | N.A. G122A | 811 | N.A. 5A2 + M106V | 1097 | N.A. 5P + N108D |
| 526 | A.A G122A | 812 | A.A 5A2 + M106V | 1098 | A.A 5P + N108D |
| 527 | N.A. G129A | 813 | N.A. 5A2 + M106W | 1099 | A.A 5P + N108E |
| 528 | A.A G129A | 814 | A.A 5A2 + M106W | 1100 | A.A 5P + N108E |
| 529 | N.A. G134A | 815 | N.A. 5A2 + M106Y | 1101 | N.A. 5P + N108F |
| 530 | A.A G134A | 816 | A.A 5A2 + M106Y | 1102 | A.A 5P + N108F |
| 531 | N.A. G147A | 817 | N.A. 5A2 + L149A | 1103 | N.A. 5P + N108G |
| 532 | A.A G147A | 818 | A.A 5A2 + L149A | 1104 | A.A 5P + N108G |
| 533 | N.A. I54A | 819 | N.A. 5A2 + L149C | 1105 | N.A. 5P + N108H |
| 534 | A.A I54A | 820 | A.A 5A2 + L149C | 1106 | A.A 5P + N108H |
| 535 | N.A. 5A1 (G15A/D19A/ G35A/G51A/G67A) | 821 | N.A. 5A2 + L149D | 1107 | N.A. 5P + N108I |
| 536 | A.A 5A1 (G15A/D19A/ G35A/G51A/G67A) | 822 | A.A 5A2 + L149D | 1108 | A.A 5P + N108I |

TABLE 2-continued

Exemplary internal tag and/or structural complement polypeptide sequences

| SEQ ID NO | Polymer | ID | SEQ ID NO | Poly. | ID | SEQ ID NO | Poly. | ID |
|---|---|---|---|---|---|---|---|---|
| 537 | N.A. | 4A1 (G15A/G35A/G67A/G71A) | 823 | N.A. | 5A2 + L149E | 1109 | N.A. | 5P + N108K |
| 538 | A.A | 4A1 (G15A/G35A/G67A/G71A) | 824 | A.A | 5A2 + L149E | 1110 | A.A | 5P + N108K |
| 539 | N.A. | 5A2 (G15A/G35A/G51A/G67A/G71A) | 825 | N.A. | 5A2 + L149F | 1111 | N.A. | 5P + N108L |
| 540 | A.A | 5A2 (G15A/G35A/G51A/G67A/G71A) | 826 | A.A | 5A2 + L149F | 1112 | A.A | 5P + N108L |
| 541 | N.A. | 5A2 + A15G | 827 | N.A. | 5A2 + L149G | 1113 | N.A. | 5P + N108M |
| 542 | A.A | 5A2 + A15G | 828 | A.A | 5A2 + L149G | 1114 | A.A | 5P + N108M |
| 543 | N.A. | 5A2 + A35G | 829 | N.A. | 5A2 + L149H | 1115 | N.A. | 5P + N108P |
| 544 | A.A | 5A2 + A35G | 830 | A.A | 5A2 + L149H | 1116 | A.A | 5P + N108P |
| 545 | N.A. | 5A2 + A51G | 831 | N.A. | 5A2 + L149I | 1117 | N.A. | 5P + N108Q |
| 546 | A.A | 5A2 + A51G | 832 | A.A | 5A2 + L149I | 1118 | A.A | 5P + N108Q |
| 547 | N.A. | 5A2 + A67G | 833 | N.A. | 5A2 + L149K | 1119 | N.A. | 5P + N108R |
| 548 | A.A | 5A2 + A67G | 834 | A.A | 5A2 + L149K | 1120 | A.A | 5P + N108R |
| 549 | N.A. | 5A2 + A71G | 835 | N.A. | 5A2 + L149M | 1121 | N.A. | 5P + N108S |
| 550 | A.A | 5A2 + A71G | 836 | A.A | 5A2 + L149M | 1122 | A.A | 5P + N108S |
| 551 | N.A. | 5A2 + R11A | 837 | N.A. | 5A2 + L149N | 1123 | N.A. | 5P + N108T |
| 552 | A.A | 5A2 + R11A | 838 | A.A | 5A2 + L149N | 1124 | A.A | 5P + N108T |
| 553 | N.A. | 5A2 + R11C | 839 | N.A. | 5A2 + L149P | 1125 | N.A. | 5P + N108V |
| 554 | A.A | 5A2 + R11C | 840 | A.A | 5A2 + L149P | 1126 | A.A | 5P + N108V |
| 555 | N.A. | 5A2 + R11D | 841 | N.A. | 5A2 + L149Q | 1127 | N.A. | 5P + N108W |
| 556 | A.A | 5A2 + R11D | 842 | A.A | 5A2 + L149Q | 1128 | A.A | 5P + N108W |
| 557 | N.A. | 5A2 + R11E | 843 | N.A. | 5A2 + L149R | 1129 | N.A. | 5P + N108Y |
| 558 | A.A | 5A2 + R11E | 844 | A.A | 5A2 + L149R | 1130 | A.A | 5P + N108Y |
| 559 | N.A. | 5A2 + R11F | 845 | N.A. | 5A2 + L149S | 1131 | N.A. | 5P + T144A |
| 560 | A.A | 5A2 + R11F | 846 | A.A | 5A2 + L149S | 1132 | A.A | 5P + T144A |
| 561 | N.A. | 5A2 + R11G | 847 | N.A. | 5A2 + L149T | 1133 | N.A. | 5P + T144C |
| 562 | A.A | 5A2 + R11G | 848 | A.A | 5A2 + L149T | 1134 | A.A | 5P + T144C |
| 563 | N.A. | 5A2 + R11H | 849 | N.A. | 5A2 + L149V | 1135 | N.A. | 5P + T144D |
| 564 | A.A | 5A2 + R11H | 850 | A.A | 5A2 + L149V | 1136 | A.A | 5P + T144D |
| 565 | N.A. | 5A2 + R11I | 851 | N.A. | 5A2 + L149W | 1137 | N.A. | 5P + T144E |
| 566 | A.A | 5A2 + R11I | 852 | A.A | 5A2 + L149W | 1138 | A.A | 5P + T144E |
| 567 | N.A. | 5A2 + R11K | 853 | N.A. | 5A2 + L149Y | 1139 | N.A. | 5P + T144F |
| 568 | A.A | 5A2 + R11K | 854 | A.A | 5A2 + L149Y | 1140 | A.A | 5P + T144F |
| 569 | N.A. | 5A2 + R11L | 855 | N.A. | 5A2 + V157A | 1141 | N.A. | 5P + T144G |
| 570 | A.A | 5A2 + R11L | 856 | A.A | 5A2 + V157A | 1142 | A.A | 5P + T144G |
| 571 | N.A. | 5A2 + R11M | 857 | N.A. | 5A2 + V157C | 1143 | N.A. | 5P + T144H |
| 572 | A.A | 5A2 + R11M | 858 | A.A | 5A2 + V157C | 1144 | A.A | 5P + T144H |
| 573 | N.A. | 5A2 + R11N | 859 | N.A. | 5A2 + V157D | 1145 | N.A. | 5P + T144I |
| 574 | A.A | 5A2 + R11N | 860 | A.A | 5A2 + V157D | 1146 | A.A | 5P + T144I |
| 575 | N.A. | 5A2 + R11P | 861 | N.A. | 5A2 + V157E | 1147 | N.A. | 5P + T144K |
| 576 | A.A | 5A2 + R11P | 862 | A.A | 5A2 + V157E | 1148 | A.A | 5P + T144K |
| 577 | N.A. | 5A2 + R11Q | 863 | N.A. | 5A2 + V157F | 1149 | N.A. | 5P + T144L |
| 578 | A.A | 5A2 + R11Q | 864 | A.A | 5A2 + V157F | 1150 | A.A | 5P + T144L |
| 579 | N.A. | 5A2 + R11S | 865 | N.A. | 5A2 + V157G | 1151 | N.A. | 5P + T144M |
| 580 | A.A | 5A2 + R11S | 866 | A.A | 5A2 + V157G | 1152 | A.A | 5P + T144M |
| 581 | N.A. | 5A2 + R11T | 867 | N.A. | 5A2 + V157H | 1153 | N.A. | 5P + T144N |
| 582 | A.A | 5A2 + R11T | 868 | A.A | 5A2 + V157H | 1154 | A.A | 5P + T144N |
| 583 | N.A. | 5A2 + R11V | 869 | N.A. | 5A2 + V157I | 1155 | N.A. | 5P + T144P |
| 584 | A.A | 5A2 + R11V | 870 | A.A | 5A2 + V157I | 1156 | A.A | 5P + T144P |
| 585 | N.A. | 5A2 + R11W | 871 | N.A. | 5A2 + V157K | 1157 | N.A. | 5P + T144Q |
| 586 | A.A | 5A2 + R11W | 872 | A.A | 5A2 + V157K | 1158 | A.A | 5P + T144Q |
| 587 | N.A. | 5A2 + R11Y | 873 | N.A. | 5A2 + V157L | 1159 | N.A. | 5P + T144R |
| 588 | A.A | 5A2 + R11Y | 874 | A.A | 5A2 + V157L | 1160 | A.A | 5P + T144R |
| 589 | N.A. | 5A2 + A15C | 875 | N.A. | 5A2 + V157M | 1161 | N.A. | 5P + T144S |
| 590 | A.A | 5A2 + A15C | 876 | A.A | 5A2 + V157M | 1440 | A.A | 5P + T144S |
| 591 | N.A. | 5A2 + A15D | 877 | N.A. | 5A2 + V157N | 1163 | N.A. | 5P + T144V |
| 592 | A.A | 5A2 + A15D | 878 | A.A | 5A2 + V157N | 1164 | A.A | 5P + T144V |
| 593 | N.A. | 5A2 + A15E | 879 | N.A. | 5A2 + V157P | 1165 | N.A. | 5P + T144W |
| 594 | A.A | 5A2 + A15E | 880 | A.A | 5A2 + V157P | 1166 | A.A | 5P + T144W |
| 595 | N.A. | 5A2 + A15F | 881 | N.A. | 5A2 + V157Q | 1167 | N.A. | 5P + T144Y |
| 596 | A.A | 5A2 + A15F | 882 | A.A | 5A2 + V157Q | 1168 | A.A | 5P + T144Y |
| 597 | N.A. | 5A2 + A15G | 883 | N.A. | 5A2 + V157R | 1169 | N.A. | 5P + P157A |
| 598 | A.A | 5A2 + A15G | 884 | A.A | 5A2 + V157R | 1170 | A.A | 5P + P157A |
| 599 | N.A. | 5A2 + A15H | 885 | N.A. | 5A2 + V157S | 1171 | N.A. | 5P + P157C |
| 600 | A.A | 5A2 + A15H | 886 | A.A | 5A2 + V157S | 1172 | A.A | 5P + P157C |
| 601 | N.A. | 5A2 + A15I | 887 | N.A | 5A2 + V157T | 1173 | N.A. | 5P + P157D |
| 602 | A.A | 5A2 + A15I | 888 | A.A | 5A2 + V157T | 1174 | A.A | 5P + P157D |

TABLE 2-continued

Exemplary internal tag and/or structural complement polypeptide sequences

| SEQ ID NO | Polymer ID | | SEQ ID NO | Poly. ID | | SEQ ID NO | Poly. ID | |
|---|---|---|---|---|---|---|---|---|
| 603 | N.A. | 5A2 + A15K | 889 | N.A. | 5A2 + V157W | 1175 | N.A. | 5P + P157E |
| 604 | A.A | 5A2 + A15K | 890 | A.A | 5A2 + V157W | 1176 | A.A | 5P + P157E |
| 605 | N.A. | 5A2 + A15L | 891 | N.A. | 5A2 + V157Y | 1177 | N.A. | 5P + P157F |
| 606 | A.A | 5A2 + A15L | 892 | A.A | 5A2 + V157Y | 1178 | A.A | 5P + P157F |
| 607 | N.A. | 5A2 + A15M | 893 | N.A. | 5A2 + Q20K | 1179 | N.A. | 5P + P157G |
| 608 | A.A | 5A2 + A15M | 894 | A.A | 5A2 + Q20K | 1180 | A.A | 5P + P157G |
| 609 | N.A. | 5A2 + A15N | 895 | N.A. | 5A2 + V27M | 1181 | N.A. | 5P + P157H |
| 610 | A.A | 5A2 + A15N | 896 | A.A | 5A2 + V27M | 1182 | A.A | 5P + P157H |
| 611 | N.A. | 5A2 + A15P | 897 | N.A. | 5A2 + N33K | 1183 | N.A. | 5P + P157I |
| 612 | A.A | 5A2 + A15P | 898 | A.A | 5A2 + N33K | 1184 | A.A | 5P + P157I |
| 613 | N.A. | 5A2 + A15Q | 899 | N.A. | 5A2 + V38I | 1185 | N.A. | 5P + P157K |
| 614 | A.A | 5A2 + A15Q | 900 | A.A | 5A2 + V38I | 1186 | A.A | 5P + P157K |
| 615 | N.A. | 5A2 + A15R | 901 | N.A. | 5A2 + I56N | 1187 | N.A. | 5P + P157L |
| 616 | A.A | 5A2 + A15R | 902 | A.A | 5A2 + I56N | 1188 | A.A | 5P + P157L |
| 617 | N.A. | 5A2 + A15S | 903 | N.A. | 5A2 + D108N | 1189 | N.A. | 5P + P157M |
| 618 | A.A | 5A2 + A15S | 904 | A.A | 5A2 + D108N | 1190 | A.A | 5P + P157M |
| 619 | N.A. | 5A2 + A15T | 905 | N.A. | 5A2 + N144T | 1191 | N.A. | 5P + P157N |
| 620 | A.A | 5A2 + A15T | 906 | A.A | 5A2 + N144T | 1192 | A.A | 5P + P157N |
| 621 | N.A. | 5A2 + A15V | 907 | N.A. | 5A2 + V27M + A35G | 1193 | N.A. | 5P + P157Q |
| 622 | A.A | 5A2 + A15V | 908 | A.A | 5A2 + V27M + A35G | 1194 | A.A | 5P + P157Q |
| 623 | N.A. | 5A2 + A15W | 909 | N.A. | 5A2 + A71G + K75E | 1195 | N.A. | 5P + P157R |
| 624 | A.A | 5A2 + A15W | 910 | A.A | 5A2 + A71G + K75E | 1196 | A.A | 5P + P157R |
| 625 | N.A. | 5A2 + A15Y | 911 | N.A. | 5A2 + R11E + L149M | 1197 | N.A. | 5P + P157S |
| 626 | A.A | 5A2 + A15Y | 912 | A.A | 5A2 + R11E + L149M | 1198 | A.A | 5P + P157S |
| 627 | N.A. | 5A2 + L18A | 913 | N.A. | 5A2 + R11E + V157P | 1199 | N.A. | 5P + P157T |
| 628 | A.A | 5A2 + L18A | 914 | A.A | 5A2 + R11E + V157P | 1200 | A.A | 5P + P157T |
| 629 | N.A. | 5A2 + L18C | 915 | N.A. | 5A2 + D108N + N144T | 1201 | N.A. | 5P + P157V |
| 630 | A.A | 5A2 + L18C | 916 | A.A | 5A2 + D108N + N144T | 1202 | A.A | 5P + P157V |
| 631 | N.A. | 5A2 + L18D | 917 | N.A. | 5A2 + L149M + V157D | 1203 | N.A. | 5P + P157W |
| 632 | A.A | 5A2 + L18D | 918 | A.A | 5A2 + L149M + V157D | 1204 | A.A | 5P + P157W |
| 633 | N.A. | 5A2 + L18E | 919 | N.A. | 5A2 + L149PM + V157P | 1205 | N.A. | 5P + P157Y |
| 634 | A.A | 5A2 + L18E | 920 | A.A | 5A2 + L149PM + V157P | 1206 | A.A | 5P + P157Y |
| 635 | N.A. | 5A2 + L18F | 921 | N.A. | 3P(5A2 + R11E + L149M + V157P) | 1207 | N.A. | 5P + I107L |
| 636 | A.A | 5A2 + L18F | 922 | A.A | 3P(5A2 + R11E + L149M + V157P) | 1208 | A.A | 5P + I107L |
| 637 | N.A. | 5A2 + L18G | 923 | N.A. | 3P + D108N | 1209 | N.A. | 5P + K75E |
| 638 | A.A | 5A2 + L18G | 924 | A.A | 3P + D108N | 1210 | A.A | 5P + K75E |
| 639 | N.A. | 5A2 + L18H | 925 | N.A. | 3P + N144T | 1211 | N.A. | 5P + K123E + N156D |
| 640 | A.A | 5A2 + L18H | 926 | A.A | 3P + N144T | 1212 | A.A | 5P + K123E + N156D |
| 641 | N.A. | 5A2 + L18I | 927 | N.A. | 3E(5A2 + R11E + L149M + V157E) | 1213 | N.A. | 5P + I76V |
| 642 | A.A | 5A2 + L18I | 928 | A.A | 3E(5A2 + R11E + L149M + V157E) | 1214 | A.A | 5P + I76V |
| 643 | N.A. | 5A2 + L18K | 929 | N.A. | 3E + D108N | 1215 | N.A. | 5P + G48D + H57R + L92M + I99V |
| 644 | A.A | 5A2 + L18K | 930 | A.A | 3E + D108N | 1216 | A.A | 5P + G48D + H57R + L92M + I99V |
| 645 | N.A. | 5A2 + L18M | 931 | N.A. | 3E + N144T | 1217 | N.A. | 5P + F31L + V36A + I99V |
| 646 | A.A | 5A2 + L18M | 932 | A.A | 3E + N144T | 1218 | A.A | 5P + F31L + V36A + I99V |
| 647 | N.A. | 5A2 + L18N | 933 | N.A. | 5P(3P + D108N + N144T) | 1219 | N.A. | 5P + F31L + H93P |
| 648 | A.A | 5A2 + L18N | 934 | A.A | 5P(3P + D108N + N144T) | 1220 | A.A | 5P + F31L + H93P |
| 649 | N.A. | 5A2 + L18P | 935 | N.A. | 6P (5P + I56N) | 1221 | N.A. | 5P + V90A |
| 650 | A.A | 5A2 + L18P | 936 | A.A | 6P (5P + I56N) | 1222 | A.A | 5P + V90A |
| 651 | N.A. | 5A2 + L18Q | 937 | N.A. | 5E(3E + D108N + N144T) | 1223 | N.A. | 5P + I44V |
| 652 | A.A | 5A2 + L18Q | 938 | A.A | 5E(3E + D108N + N144T) | 1224 | A.A | 5P + I44V |
| 653 | N.A. | 5A2 + L18R | 939 | N.A. | 6E (5E + I56N) | 1225 | N.A. | 5P + L46R + H86Q + M106V |
| 654 | A.A | 5A2 + L18R | 940 | A.A | 6E (5E + I56N) | 1226 | A.A | 5P + L46R + H86Q + M106V |
| 655 | N.A. | 5A2 + L18S | 941 | N.A. | NLpoly1 (5A2 + R11N + A15S + L18Q + F31I + V58A + A67D + M106V + L149M + V157D) | 1227 | N.A. | 5P + R141H |
| 656 | A.A | 5A2 + L18S | 942 | A.A | NLpoly1 (5A2 + R11N + A15S + L18Q + F31I + V58A + A67D + M106V + L149M + V157D) | 1228 | A.A | 5P + R141H |

TABLE 2-continued

Exemplary internal tag and/or structural complement polypeptide sequences

| SEQ ID NO | Polymer ID | Poly. ID | SEQ ID NO | Poly. ID | | SEQ ID NO | Poly. ID |
|---|---|---|---|---|---|---|---|
| 657 | N.A. | 5A2 + L18T | 943 | N.A. | NLpoly2 (5A2 + A15S + L18Q + F31I + V58A + A67D + M106V + L149M + V157D) | 1229 | N.A. 5P + N33D + V58A |
| 658 | A.A | 5A2 + L18T | 944 | A.A | NLpoly2 (5A2 + A15S + L18Q + F31I + V58A + A67D + M106V + L149M + V157D) | 1230 | A.A 5P + N33D + V58A |
| 659 | N.A. | 5A2 + L18V | 945 | N.A. | NLpoly3 (5A2 + R11N + L18Q + F31I + V58A + A67D + M106V + L149M + V157D) | 1231 | N.A. 5P + I56N + P157H |
| 660 | A.A | 5A2 + L18V | 946 | A.A | NLpoly3 (5A2 + R11N + L18Q + F31I + V58A + A67D + M106V + L149M + V157D) | 1232 | A.A 5P + I56N + P157H |
| 661 | N.A. | 5A2 + L18W | 947 | N.A. | NLpoly4 (5A2 + R11N + A15S + F31I + V58A + A67D + M106V + L149M + V157D) | 1233 | N.A. 5P + L46Q + P157H |
| 662 | A.A | 5A2 + L18W | 948 | A.A | NLpoly4 (5A2 + R11N + A15S + F31I + V58A + A67D + M106V + L149M + V157D) | 1234 | A.A 5P + L46Q + P157H |
| 663 | N.A. | 5A2 + L18Y | 949 | N.A. | NLpoly5 (5A2 + R11N + A15S + L18Q + V58A + A67D + M106V + L149M + V157D) | 1235 | N.A. 5P + I59V |
| 664 | A.A | 5A2 + L18Y | 950 | A.A | NLpoly5 (5A2 + R11N + A15S + L18Q + V58A + A67D + M106V + L149M + V157D) | 1236 | A.A 5P + I59V |
| 665 | N.A. | 5A2 + F31A | 951 | N.A. | NLpoly6 (5A2 + R11N + A15S + L18Q + F31I + A67D + M106V + L149M + V157D) | 1237 | N.A. 5P + A51T + E74K + P113L |
| 666 | A.A | 5A2 + F31A | 952 | A.A | NLpoly6 (5A2 + R11N + A15S + L18Q + F31I + A67D + M106V + L149M + V157D) | 1238 | A.A 5P + A51T + E74K + P113L |
| 667 | N.A. | 5A2 + F31C | 953 | N.A. | NLpoly7 (5A2 + R11N + A15S + L18Q + F31I + V58A + M106V + L149M + V157D) | 1239 | N.A. 5P + V36A |
| 668 | A.A | 5A2 + F31C | 954 | A.A | NLpoly7 (5A2 + R11N + A15S + L18Q + F31I + V58A + M106V + L149M + V157D) | 1240 | A.A 5P + V36A |
| 669 | N.A. | 5A2 + F31D | 955 | N.A. | NLpoly8 (5A2 + R11N + A15S + L18Q + F31I + V58A + A67D + L149M + V157D) | 1241 | N.A. 5P + A51T |
| 670 | A.A | 5A2 + F31D | 956 | A.A | NLpoly8 (5A2 + R11N + A15S + L18Q + F31I + V58A + A67D + L149M + V157D) | 1242 | A.A 5P + A51T |

TABLE 2-continued

Exemplary internal tag and/or structural complement polypeptide sequences

| SEQ ID NO | Polymer ID | Polymer ID | SEQ ID NO | Poly. ID | Poly. ID | SEQ ID NO | Poly. ID | Poly. ID |
|---|---|---|---|---|---|---|---|---|
| 671 | N.A. | 5A2 + F31E | 957 | N.A. | NLpoly9 (5A2 + R11N + A15S + L18Q + F31I + V58A + A67D + M106V + V157D) | 1243 | N.A. | 5P + H57R |
| 672 | A.A | 5A2 + F31E | 958 | A.A | NLpoly9 (5A2 + R11N + A15S + L18Q + F31I + V58A + A67D + M106V + V157D) | 1244 | A.A | 5P + H57R |
| 673 | N.A. | 5A2 + F31G | 959 | N.A. | NLpoly10 (5A2 + R11N + A15S + L18Q + F31I + V58A + A67D + M106V + L149M) | 1245 | N.A. | 5P + V58A |
| 674 | A.A | 5A2 + F31G | 960 | A.A | NLpoly10 (5A2 + R11N + A15S + L18Q + F31I + V58A + A67D + M106V + L149M) | 1246 | A.A | 5P + V58A |
| 675 | N.A. | 5A2 + F31H | 961 | N.A. | NLpoly11 (5A2 + A15S + L18Q + M106V + L149M + V157D) | 1247 | N.A. | 5P + E74K |
| 676 | A.A | 5A2 + F31H | 962 | A.A | NLpoly11 (5A2 + A15S + L18Q + M106V + L149M + V157D) | 1248 | A.A | 5P + E74K |
| 677 | N.A. | 5A2 + F31I | 963 | N.A. | NLpoly12 (5A2 + A15S + L18Q + A67D + M106V + L149M + V157D) | 1249 | N.A. | 5P + H86Q |
| 678 | A.A | 5A2 + F31I | 964 | A.A | NLpoly12 (5A2 + A15S + L18Q + A67D + M106V + L149M + V157D) | 1250 | A.A | 5P + H86Q |
| 679 | N.A. | 5A2 + F31K | 965 | N.A. | NLpoly13 (5A2 + R11N + A15S + L18Q + M106V + L149M + V157D) | 1251 | N.A. | 5P + H93P |
| 680 | A.A | 5A2 + F31K | 966 | A.A | NLpoly13 (5A2 + R11N + A15S + L18Q + M106V + L149M + V157D) | 1252 | A.A | 5P + H93P |
| 681 | N.A. | 5A2 + F31L | 967 | N.A. | 5P + V | 1253 | N.A. | 5P + I99V |
| 682 | A.A | 5A2 + F31L | 968 | A.A | 5P + V | 1254 | A.A | 5P + I99V |
| 683 | N.A. | 5A2 + F31M | 969 | N.A. | 5P + A | 1255 | N.A. | 5P + K123E |
| 684 | A.A | 5A2 + F31M | 970 | A.A | 5P + A | 1256 | A.A | 5P + K123E |
| 685 | N.A. | 5A2 + F31N | 971 | N.A. | 5P + VT | 1257 | N.A. | 5P + T128S |
| 686 | A.A | 5A2 + F31N | 972 | A.A | 5P + VT | 1258 | A.A | 5P + T128S |
| 687 | N.A. | 5A2 + F31P | 973 | N.A. | 5P + VA | 1259 | N.A. | 5P + L142Q + T154N |
| 688 | A.A | 5A2 + F31P | 974 | A.A | 5P + VA | 1260 | A.A | 5P + L142Q + T154N |
| 689 | N.A. | 5A2 + F31Q | 975 | N.A. | 5P + AT | 1261 | N.A. | 5P + H57Q |
| 690 | A.A | 5A2 + F31Q | 976 | A.A | 5P + AT | 1262 | A.A | 5P + H57Q |
| 691 | N.A. | 5A2 + F31R | 977 | N.A. | 5P + AA | 1263 | N.A. | 5P + L92M |
| 692 | A.A | 5A2 + F31R | 978 | A.A | 5P + AA | 1264 | A.A | 5P + L92M |
| 693 | N.A. | 5A2 + F31S | 979 | N.A. | 5P + GG | 1265 | N.A. | 5P + P113L |
| 694 | A.A | 5A2 + F31S | 980 | A.A | 5P + GG | 1266 | A.A | 5P + P113L |
| 695 | N.A. | 5A2 + F31T | 981 | N.A. | 5P + AA | 1267 | N.A. | 5P + G48D |
| 696 | A.A | 5A2 + F31T | 982 | A.A | 5P + AA | 1268 | A.A | 5P + G48D |
| 697 | N.A. | 5A2 + F31V | 983 | N.A. | 5P + ATG | 1269 | N.A. | 5P-B9 (-147-157) |
| 698 | A.A | 5A2 + F31V | 984 | A.A | 5P + ATG | 1270 | A.A | 5P-B9 (-147-157) |
| 699 | N.A. | 5A2 + F31W | 985 | N.A. | 5P + VTG | 1271 | N.A. | 5P + L46R + P157S |
| 700 | A.A | 5A2 + F31W | 986 | A.A | 5P + VTG | 1272 | A.A | 5P + L46R + P157S |
| 701 | N.A. | 5A2 + F31Y | 987 | N.A. | 5P + VTA | 1273 | N.A. | 5P + L46H + P157H |
| 702 | A.A | 5A2 + F31Y | 988 | A.A | 5P + VTA | 1274 | A.A | 5P + L46H + P157H |
| 703 | N.A. | 5A2 + V58A | 989 | N.A. | 5P + GTA | 1275 | N.A. | 5P + L46R + H93P |
| 704 | A.A | 5A2 + V58A | 990 | A.A | 5P + GTA | 1276 | A.A | 5P + L46R + H93P |
| 705 | N.A. | 5A2 + V58C | 991 | N.A. | 5P + VTGW | 1277 | N.A. | 5P + L46R + H93P + F31L |
| 706 | A.A | 5A2 + V58C | 992 | A.A | 5P + VTGW | 1278 | A.A | 5P + L46R + H93P + F31L |
| 707 | N.A. | 5A2 + V58D | 993 | N.A. | 5P + VTGWR | 1279 | N.A. | 5P + L46R + H93P + K75E |

TABLE 2-continued

Exemplary internal tag and/or structural complement polypeptide sequences

| SEQ ID NO | Polymer ID | | SEQ ID NO | Poly. ID | | SEQ ID NO | Poly. ID | |
|---|---|---|---|---|---|---|---|---|
| 708 | A.A | 5A2 + V58D | 994 | A.A | 5P + VTGWR | 1280 | A.A | 5P + L46R + H93P + K75E |
| 709 | N.A. | 5A2 + V58E | 995 | N.A. | 5P + VTGWE | 1281 | N.A. | 5P + L46R + H93P + I76V |
| 710 | A.A | 5A2 + V58E | 996 | A.A | 5P + VTGWE | 1282 | A.A | 5P + L46R + H93P + I76V |
| 711 | N.A. | 5A2 + V58F | 997 | N.A. | 5P + VTGWK | 1283 | N.A. | 8S(5P + L46R + H93P + P157S + F31L) |
| 712 | A.A | 5A2 + V58F | 998 | A.A | 5P + VTGWK | 1284 | A.A | 8S(5P + L46R + H93P + P157S + F31L) |
| 713 | N.A. | 5A2 + V58G | 999 | N.A. | 5P + VTGWQ | 1285 | N.A. | 5P + L46R + H93P + P157S + K75E |
| 714 | A.A | 5A2 + V58G | 1000 | A.A | 5P + VTGWQ | 1286 | A.A | 5P + L46R + H93P + P157S + K75E |
| 715 | N.A. | 5A2 + V58H | 1001 | N.A. | 5P + VTGWH | 1287 | N.A. | 5P + L46R + H93P + P157S + I76V |
| 716 | A.A | 5A2 + V58H | 1002 | A.A | 5P + VTGWH | 1288 | A.A | 5P + L46R + H93P + P157S + I76V |
| 717 | N.A. | 5A2 + V58I | 1003 | N.A. | 5P D1 (−157) | 1289 | N.A. | 12S(8S + A51T + K75E + I76V + I107L) |
| 718 | A.A | 5A2 + V58I | 1004 | A.A | 5P D1 (−157) | 1290 | A.A | 12S(8S + A51T + K75E + I76V + I107L) |
| 719 | N.A. | 5A2 + V58K | 1005 | N.A. | 5P D2 (−156-157) | 1291 | N.A. | 11S (12-A51T) |
| 720 | A.A | 5A2 + V58K | 1006 | A.A | 5P D2 (−156-157) | 1292 | A.A | 11S (12-A51T) |
| 721 | N.A. | 5A2 + V58L | 1007 | N.A. | 5P D3 (−155-157) | 1293 | N.A. | 12S-K75E |
| 722 | A.A | 5A2 + V58L | 1008 | A.A | 5P D3 (−155-157) | 1294 | A.A | 12S-K75E |
| 723 | N.A. | 5A2 + V58M | 1009 | N.A. | 5P D4 (−154-157) | 1295 | N.A. | 12S-I76V |
| 724 | A.A | 5A2 + V58M | 1010 | A.A | 5P D4 (−154-157) | 1296 | A.A | 12S-I76V |
| 725 | N.A. | 5A2 + V58N | 1011 | N.A. | 5P D5 (−153-157) | 1297 | N.A. | 12S-I107L |
| 726 | A.A | 5A2 + V58N | 1012 | A.A | 5P D5 (−153-157) | 1298 | A.A | 12S-I107L |

The polypeptides and coding nucleic acid sequences of Table 2 (SEQ ID NOS: 441-1298) all contain N-terminal Met residues (amino acids) or ATG start codons (nucleic acids). In some embodiments, the polypeptides and coding nucleic acid sequences of Table 2 are provided without N-terminal Met residues or ATG start codons (SEQ ID NOS: 1299-2156).

In certain embodiments, an internal tag and/or structural complement comprises one of the amino acid polymers of SEQ ID NOS: 441-2156. In some embodiments, an internal tag and/or structural complement comprises a single amino acid difference from SEQ ID NO: 440. In some embodiments, an internal tag and/or structural complement comprises two or more (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30 . . . 35 . . . 40 . . . 45 . . . 50, or more) amino acid differences from SEQ ID NO: 440 and/or any of the amino acid polymers of SEQ ID NOS:441-2156. In some embodiments, an internal tag and/or structural complement are provided comprising the sequence of one of the amino acid polymers of SEQ ID NOS: 441-2156 with one or more additions, substitutions, and/or deletions. In some embodiments, an internal tag and/or structural complement or a portion thereof comprises greater than 70% sequence identity (e.g., >71%, >75%, >80%, >85%, >90%, >91%, >92%, >93%, >94%, >95%, >96%, >97%, >98%, or >99%) with one or more of the amino acid polymers of SEQ ID NOS: 441-2156.

In certain embodiments, a nucleic acid from Table 2 is provided. In some embodiments, a nucleic acid encoding a polypeptide from Table 2 (e.g., inserted into a polypeptide of interest) is provided. In some embodiments, a nucleic acid of the present invention codes for a polypeptide that comprises a single amino acid difference from SEQ ID NO: 440 and/or any of the amino acid polymers of SEQ ID NOS: 441-2156 (e.g., inserted into a polypeptide of interest). In some embodiments, nucleic acids code for a polypeptide comprising two or more (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30 . . . 35 . . . 40 . . . 45 . . . 50, or more) amino acid differences from SEQ ID NO: 440 and/or any of the polypeptides listed in Table 2 (e.g., inserted into a polypeptide of interest). In some embodiments, nucleic acids are provided comprising the sequence of one of the nucleic acid polymers of SEQ ID NOS: 441-2156 (e.g., inserted into a polypeptide of interest). In some embodiments, nucleic acids are provided comprising the sequence of one of the nucleic acid polymers of SEQ ID NOS: 441-2156 with one or more additions, substitutions, and/or deletions. In some embodiments, a nucleic acid or a portion thereof comprises greater than 70% sequence identity (e.g., >71%, >75%, >80%, >85%, >90%, >91%, >92%, >93%, >94%, >95%, >96%, >97%, >98%, or >99%) with one or more of the nucleic acid polymers of SEQ ID NOS: 441-2156 (e.g., inserted into a polypeptide of interest). In some embodiments, a nucleic acid or a portion thereof codes for an polypeptide comprising greater than 70% sequence identity (e.g., >71%, >75%, >80%, >85%, >90%, >91%, >92%, >93%, >94%, >95%, >96%, >97%, >98%, or >99%) with one or more of the amino acid polymers of SEQ ID NOS: 441-2156 (e.g., inserted into a polypeptide of interest). In some embodiments, nucleic acids are provided that code for one of the polypeptides of SEQ ID NOS: 441-2156 (e.g., inserted into a polypeptide of interest). In some embodiments, nucleic acids are provided that code for one of the polypeptides of SEQ ID NOS: 441-2156 with one or more additions, substitutions, and/or deletions (e.g., inserted into a polypeptide of interest).

The present invention provides compositions and methods that are useful in a variety of fields including basic research, medical research, molecular diagnostics, etc. The reagents and assays described herein are not limited to any particular applications, and any useful application should be viewed as being within the scope of the present invention.

Typical applications that make use of embodiments of the present invention involve the monitoring/detection of protein-protein interactions (e.g., heterodimers, homodimers) (See FIG. 1), protein-RNA interactions, protein-DNA interactions, protein-small molecule interactions, or any other combinations of molecular entities. A protein of interest is internally tagged and the second entity of interest is attached to the structural complement. If a detectable signal is produced under the particular assay conditions, then interaction of the protein of interest and the entity of interest is inferred. Such assays are useful for monitoring molecular interactions under any suitable conditions (e.g., in vitro, in vivo, in situ, whole animal, etc.), and find use in, for example, drug discovery, elucidating molecular pathways, studying equilibrium or kinetic aspects of complex assembly, high throughput screening, proximity sensor, etc.

Figure 2:
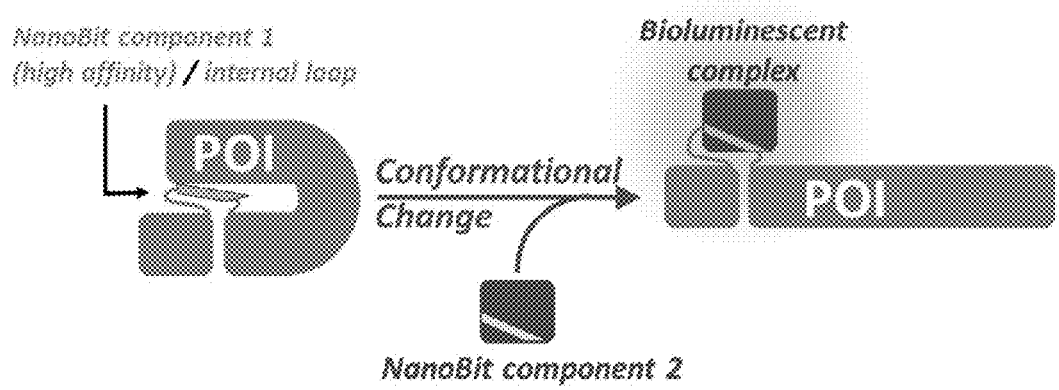
FIG. 2 shows a schematic depiction of an exemplary embodiment in which an internal tag (e.g., NLpep or NLpoly) is inserted into a first protein of interest (POI 1), and a free complement sequence (e.g., NLpep or NLpoly) is provided. In this example, the internal tag is placed in a position that is accessible only after the protein of interest undergoes a conformational change that allows the internal tag to be accessible by the complement sequence. The internal tag and complement sequence have high affinity for each other such that a complex forms when the internal tag and complement sequence associate. A bioluminescent complex is then formed between the internal tag and complement sequence when they are present in the same sample.
Figure 3:
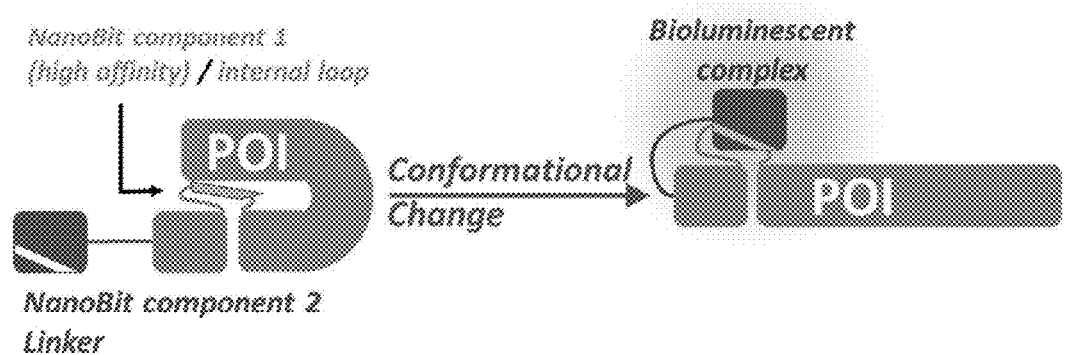
FIG. 3 shows a schematic depiction of an exemplary embodiment in which an internal tag (e.g., NLpep or NLpoly) and its structural complement are inserted/fused to a polypeptide of interest (POI 1). In this example, the internal tag is placed in a position that is accessible only after the protein of interest undergoes a conformational change that allows the internal tag to be accessible by the complement sequence. The internal tag and complement sequence have high affinity for each other such that a complex forms when the internal tag and complement sequence associate. A bioluminescent complex is then formed between the internal tag and complement sequence when they are present in the same sample.

Other typical applications that make use of embodiments of the present invention involve the detection or localization (e.g., cellular localization, subcellular localization, etc.) of a protein or polypeptide (See FIG. 2). A protein of interest in a sample is internally tagged, and a structural complement is added to the sample. If a detectable signal is produced under the particular assay conditions, then the presence or location of the protein of interest is inferred. Such assays are useful for detecting or localizing a protein under any suitable conditions (e.g., in vitro, in vivo, in situ, whole animal, etc.), and find use in, for example, drug discovery, elucidating molecular pathways, studying equilibrium or kinetic aspects of complex assembly, high throughput screening, proximity sensor, etc.

In some embodiments, an internal tag and structural complement of known characteristics (e.g., spectral characteristics, mutual affinity of pair) is used to elucidate the affinity of, or understand the interaction of, a protein of interest and a potentially associated entity of interest (protein, nucleic acid, small molecule, etc.). In other embodiments, a well-characterized interaction pair is used to determine the characteristics (e.g., spectral characteristics, mutual affinity of pair) of an internal tag and structural complement.

Embodiments described herein find use in drug screening and/or drug development. For example, the interaction of a small molecule drug or an entire library of small molecules (e.g., labeled with structural complement) with an internally tagged target protein of interest (e.g., therapeutic target) is monitored under one or more relevant conditions (e.g., physiological conditions, disease conditions, etc.). In other embodiments, the ability of a small molecule drug or an entire library of small molecules to enhance or inhibit the interactions between two entities (e.g., receptor and ligand, protein-protein, etc.) is assayed. In some embodiments, drug screening applications are carried out in a high through-put format to allow for the detection of the binding of tens of thousands of different molecules to a target, or to test the effect of those molecules on the binding of other entities.

In some embodiments, the present invention provides the detection of molecular interactions in living organisms (e.g., bacteria, yeast, eukaryotes, mammals, primates, human, etc.) and/or cells. In some embodiments, internally tagged protein and complement-labeled protein are co-expressed in the cell or whole organism, and signal is detected and correlated to the formation of the interaction complex. In some embodiments, cells are transiently and/or stably transformed or transfected with vector(s) (e.g., encoding internally-tagged protein, complement-labeled protein, etc.). In some embodiments, transgenic organisms are generated that code for the necessary components (e.g., internally-tagged protein, complement-labeled protein, etc.) for carrying out the assays described herein. In other embodiments, vectors are injected into whole organisms.

The present invention also provides methods for the design and/or optimization of internal tags and structural complements and the bioluminescent complexes that form therefrom. Any suitable method for the design of non-luminescent pairs/groups that are consistent with embodiments described herein, and/or panels thereof, is within the scope of the present invention.

EXPERIMENTAL

Example 1

Figure 4:
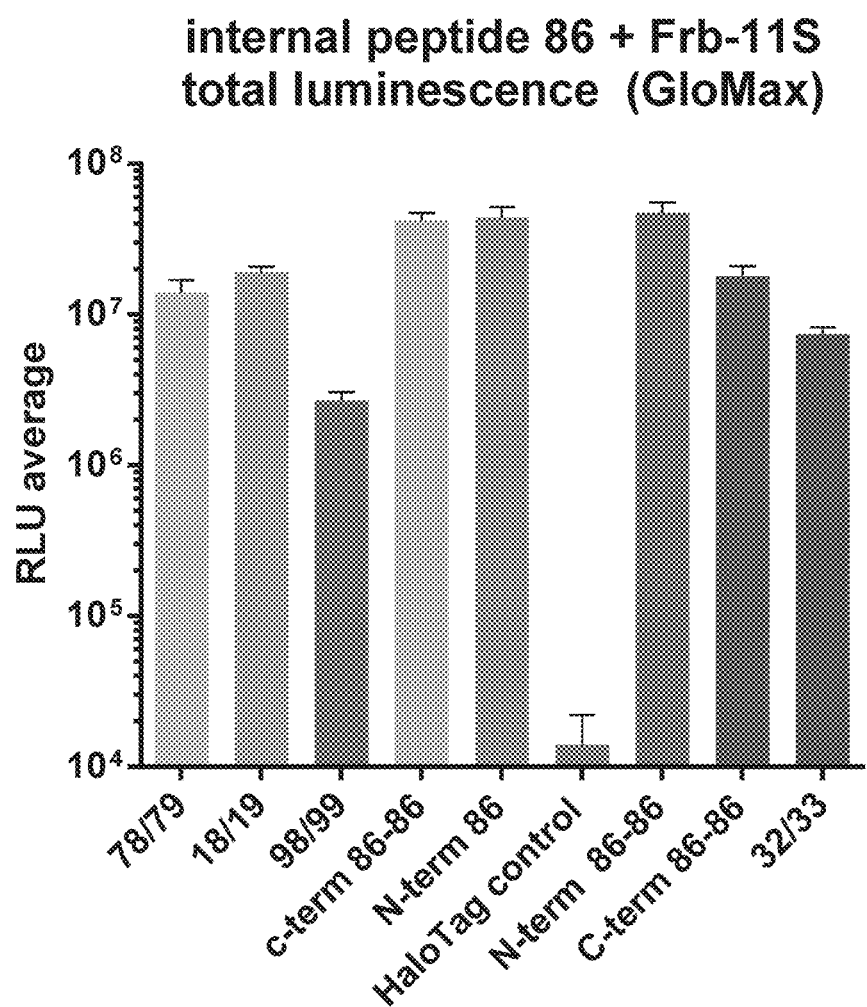
FIG. 4 shows the results of a representative experiment demonstrating structural complementation of the high affinity NLpeptide86 internal tag inserted into the HALOTAG protein (Promega Corp) and NLpoly11S. In this experiment, HeLa cells were transfected with the expression constructs for the indicated constructs. The cells were incubated for 24 hours. Luminescence of each sample was measured following addition of the NANOLUC substrate furimazine
Figure 5:
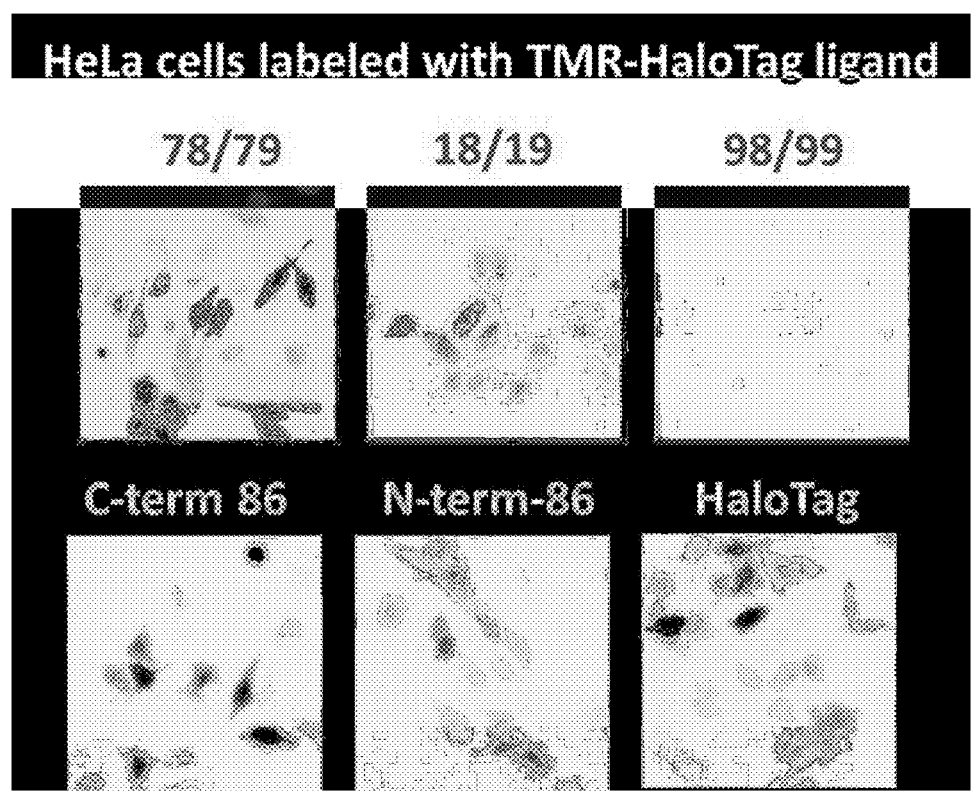
FIG. 5 shows an image demonstrating function of a HALOTAG protein (Promega Corp) having the high affinity NLpeptide86 inserted therein.
Figure 6:
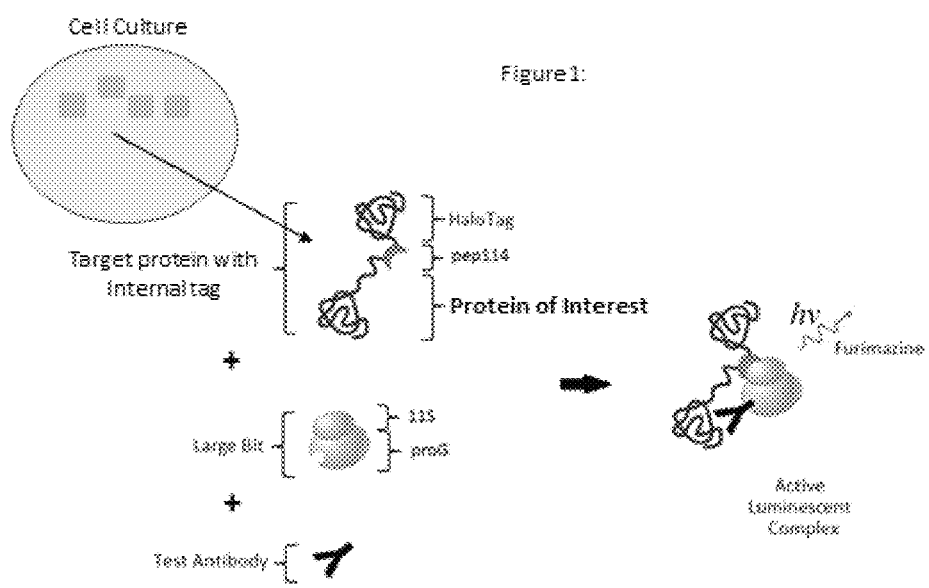
FIG. 6 depicts a schematic of how the assay components are used to screen for antibody binding to target protein by way of antibody driven NANOLUC bioluminescence complementation between NLpoly11S-fused protein G and internally tagged NLpep114 target protein. The Target, containing an internal pep114 tag, is expressed in mammalian cell culture with an IL6 signal peptide (SP). The SP directs the Target to the secretion pathway. The Target can be assayed in the media (+/−) cells. In the example, a purified preparation of the Large Bit (11S-protein G fusion protein) and Test Antibody are added directly to the mammalian cell culture. The protein G domain of the Large Bit binds to the Fc region of the Test Antibody between the Heavy Chain Constant Domains 2 and 3. If the Test Antibody binds to the Target, the Large and Small Bits can come together to form an active luminescent complex that is detected by furimazine.
Figure 8:
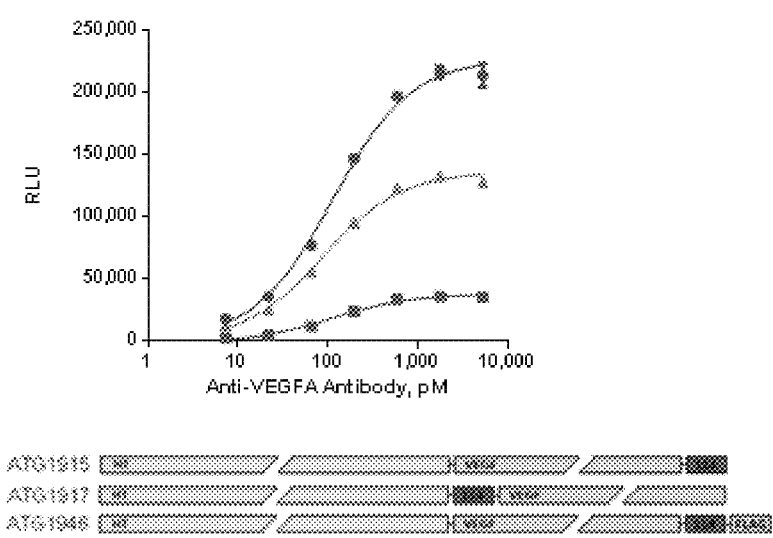
FIG. 8 shows target antibody specific NANOLUC bioluminescence complementation by the detection of anti-VEGFA specific antibody binding to the NLpep114 tagged VEGFA target proteins as determined by an increase in bioluminescence in an antibody concentration dependent manner. This increase in bioluminescence was antibody:target specific as isotype controls did not produce light (not shown).
Figure 9:
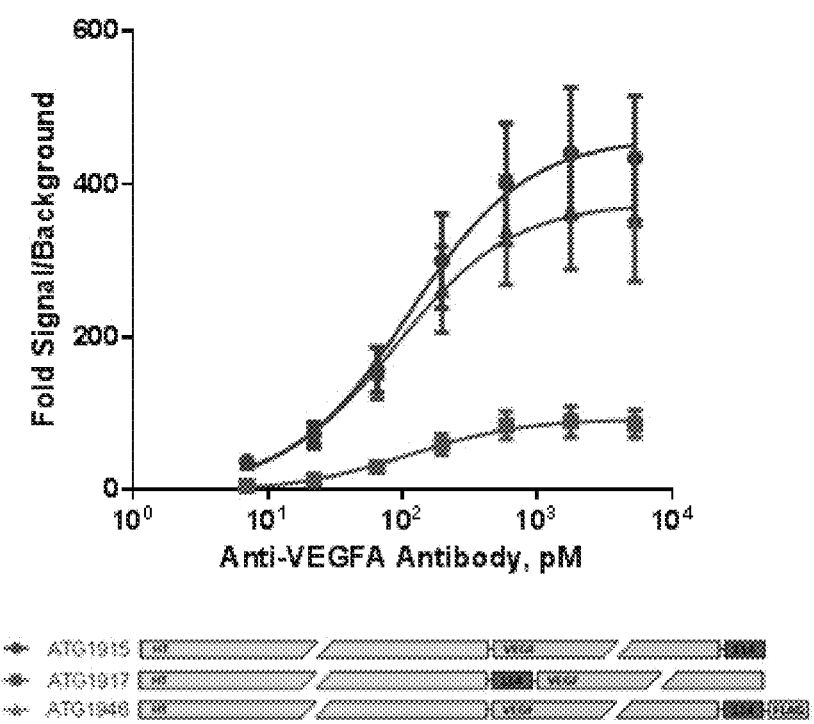
FIG. 9 shows target antibody specific NANOLUC bioluminescence complementation as fold signal/background. The signal window of detection of anti-VEGFA specific antibody binding to the NLpep114 tagged VEGFA target proteins as determined by the increase in bioluminescence in the presence of antibody over background of assay components without antibody present. The signal over background in RLU was calculated from data obtained in FIG. 8 and found to increase from 75-450 fold in response to increasing anti-VEGFA antibody over the concentration range used.
Figure 10:
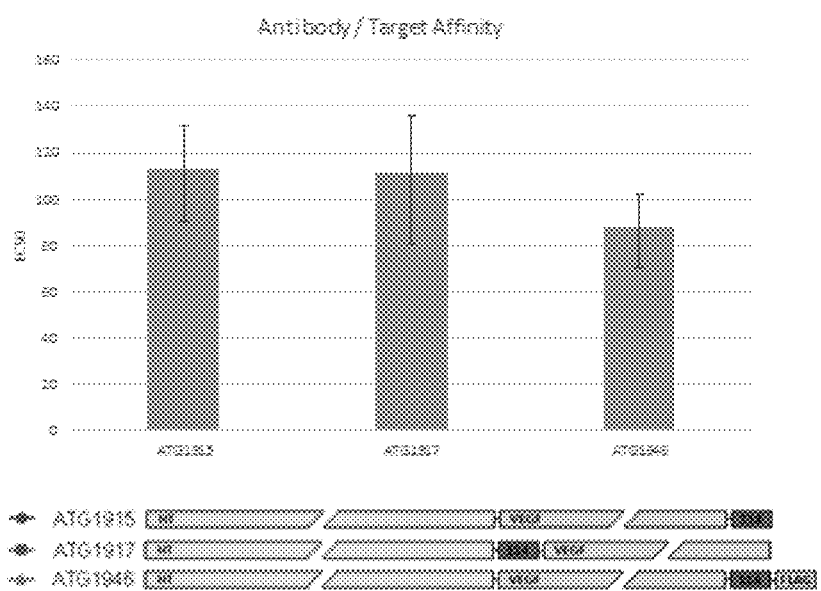
FIG. 10 demonstrates the affinity of the antibody for the target is unchanged by the position of NLpep114, as shown by anti-VEGFA antibody relative affinity through bioluminescence complementation dose response. The $EC_{50}$ values for the three VEGFA target constructs are shown as calculated off the dose response curves generated in FIG. 8.
Figure 11:
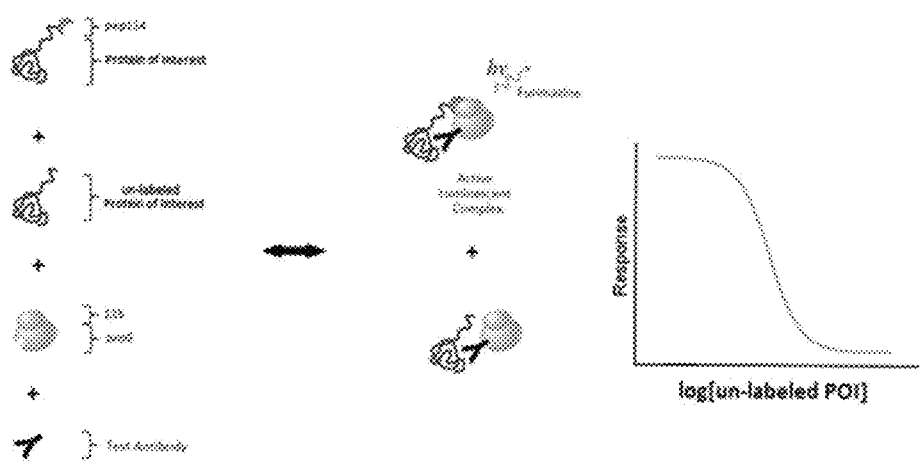
FIG. 11 depicts the schematic of how the assay components are used to quantify endogenous target protein along with prophetic data analysis by way of endogenous target protein competition with NLpep114 tagged target protein and antibody driven NANOLUC bioluminescence complementation between NLpoly11S-fused protein G and internally tagged NLpep114 target protein. Assay components configured to allow for quantitation of endogenous target protein of interest. Using the same target protein pep114 fusions and 11S-protein G fusions, one can quantitate the amount of endogenous target protein through binding competition resulting in a decrease in signal as endogenous target protein increases.
Figure 12:
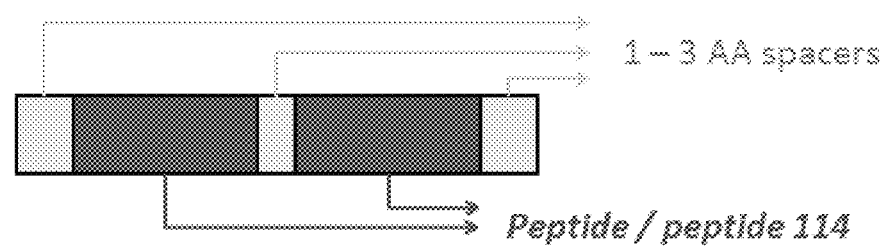
FIG. 12 depicts a schematic representation and sequence of the 114 tandem peptide used for internal tagging.

Experiments were conducted during development of embodiments of the present invention to demonstrate structural complementation between the non-luminescent polypeptide, NLpoly11S and the high affinity, non-luminescent peptide, NLpep86, as an experimental model. HaloTag was selected as the target for insertion of the NLpep86. A number of HaloTag-NLpep86 fusion proteins were generated by inserting a tandem of NLpep86 (high affinity, sequence GSSG-[VSGWRLFKKIS]-E-[VSGWRLFKKIS]-GSSG) at various sites within the HaloTag® protein (insertion sites: 18/19, 32/33, 78/79, 98/99). Initial experiments were performed in HeLa cells transiently transfected with NLpoly11S and the indicated HaloTag-NLpep86 fusion proteins. The results show that it is possible to achieve structural complementation between NLpoly11S and NLpep86 inserted at different positions within HaloTag (FIG. 4). HaloTag function was determined by BRET (which requires the ability of modified HaloTag to bind HaloTag ligand, FIG. 4) or imaging of TMR-HT ligand labeled cells (FIG. 5). It was demonstrated that insertion of NLpep86 is compatible with HaloTag function (FIG. 5). The observed efficiency of structural complementation using internal fusions varies between 1-40% relative to N- or C-terminal NLpep86 fusions to HaloTag using NLpoly11S and NLpep86.

Example 2

Experiments were conducted to demonstrate test antibody driven NANOLUC bioluminescence complementation using an NLpep114 internally tagged target protein and an NLpoly11S tagged protein G.

Construction, Expression, and Purification of Protein G-11S

ATG-2071 (NLpoly11S-tagged protein G) plasmid (SEQ ID NO: 2576): Amino acids 303-497 from Immunoglobulin G-binding protein G [Uniprot P19909] were amplified from a synthetic gene (GenScript) to add a 6× His tag and cloned into pF5K (Flexi vector, CMV promoter) containing linker-NLpoly11S. The 6×His-proteinG-NLpoly11S fusion was then subcloned into pF1A (Flexi vector, T7 promoter; Promega) for bacterial expression.

NLpoly11S-tagged protein G was produced in an *E. coli* expression system by the Glucose/Rhamnose Auto-Induction Method. Briefly, plasmid ATG-2071 was transformed into *E. coli* KRX cells (Promega) using the manufacturer's recommended protocol and grown 17-22 hrs at 37° C. with shaking (275 rpm) in LB media (50 ml) containing antibiotic. This starter culture was diluted (1:100) into 250 ml of auto-induction media (LB media with glucose and rhamnose (0.05% each) and antibiotic) and grown 17-22 hrs at 25° C. with shaking (275 rpm). Cells were collected by centrifugation (5,000×g for 20 min at 4° C.), the media removed, and the bacterial cell pellet stored at −20° C.

Pelleted cells were re-suspended in 50 ml Lysis Buffer (100 mM HEPES (pH 7.5), 500 mM NaCl, 10 mM Imidazole, 0.5× FastBreak (Promega), 1× Protease Inhibitor Cocktail (Promega), 0.2 mg/ml lysozyme (Sigma) and 250 units of RQ1 DNase (Promega)), and then incubated at ambient temperature for 30 min with occasional mixing. The soluble fraction was separated by centrifugation (15,000×g for 20 min at 4° C.) and applied (1 ml/min) to a 5 ml HisTrap column (Life Technologies) equilibrated with Start Buffer (50 mM HEPES (pH 7.5), 500 mM NaCl, 10 mM Imidazole). After sample application, the resin was washed with 4 CVs Start Buffer. Bound protein was eluted with a 20 CV linear gradient, 0-100% Limit Buffer (50 mM HEPES (pH 7.5), 500 mM Imidazole). Fractions (2.5 ml) were analyzed by SDS/PAGE. Those with significant amounts of a major 41 kDa band (NLpoly11S/pG) and minimal contaminants were pooled and dialyzed against 1×PBS and stored at −20° C.

Methods for Expression Plasmid Construction for VEGFA Constructs

VEGF constructs ATG-1915 (SEQ ID NO: 2577), -1917 (SEQ ID NO: 2578) and -1946 (SEQ ID NO: 2579) were built by transferring VEGFA-165 fused to either NLpep114 and/or FLAG octapeptide (both synthetic genes; Gene Dynamics) into the vector pCIHN (Flexi vector, CMV promoter; Promega). This vector contains an N-terminal HaloTag with an IL6 secretion signal.

General Cell Transfection Protocol

NLpep114-target fusion construct DNA was diluted into carrier DNA (pGEM3Zf(−); Promega) at 10 ug total DNA at a mass ratio of 1:10. DNA:FuGENE complexes were formed at a ratio of 1:3 (ug DNA/ul FuGENE), according to manufacturer's protocol (Promega). One part of the transfection complex was mixed with 20 parts (volume/volume) of HEK293T cells (ATCC) suspended at a density of $2 \times 10^5$ cells/ml in DMEM (Gibco)+10% FBS (Hyclone). Cells (50 ul/well) were dispensed into 96-well tissue culture plates and incubated in a humidified, 37° C./5% $CO_2$ incubator for 18-24 hours.

Target Antibody Driven NANOLUC Bioluminescence Complementation

HEK293T cells (ATCC) were transfected with three NLpep114-VEGFA DNAs as described above and incubated overnight. The cells were serum starved for 4 hours under the same conditions by replacing the media with an equal volume of opti-MEM (Gibco). NLpoly11S(15)pG in 1×PBS/0.1% BSA (Promega) was added (25 ul/well) to a final concentration of 0.5 ug/ml (12 nM). Anti-VEGF antibody (R&D Systems, #293) in 1×PBS/0.1% BSA (Promega) was added (25 ul/well) to a final concentration of 0-0.73 ug/ml (0-5.3 nM). After the addition of LCS Reagent (Promega, 100 ul/well, 10 uM final concentration), luciferase activity was measured using an Infinity F500 microtiter plate reader (Tecan).

FIGS. 6-11 demonstrate that when incubated together, the NLpep114-VEGF fusion protein, the NLpoly11S-protein G fusion protein, and the un-modified anti-VEGF antibody come together to form an active luciferase complex. The signal is measurable, but extremely low in the absence of antibody. Given the high $K_D$ of the NLpoly11S/NLpep114 interaction, non-facilitated complementation should be extremely low at the concentrations used. This indicates that the NLpoly11S fragment has some low level of residual luciferase activity. For ATG-1915 (HT-VEGF-114), this background signal increased by over 400-fold as the anti-VEGF antibody concentration increased from 0-0.73 ug/ml (0-5.3 nM).

The context of the NLpep114 tag influences the overall system performance. ATG-1915 with a C-terminal (external) NLpep114 tag has the highest signal. This construct suffers a 40% signal loss when the NLpep114 tag is slightly internalized by the addition of a C-terminal FLAG sequence (ATG-1946). When placed between two large domains, the signal is reduced 5-fold (ATG-1917). Note that while the total signal varies with the position of the NLpep114 tag, the calculated $EC_{50}$ remains constant. The context of the NLpep114 tag changes the level of complementation, but not the affinity of the NLpoly11S/NLpep114 pair.

Example 3

Figure 13:
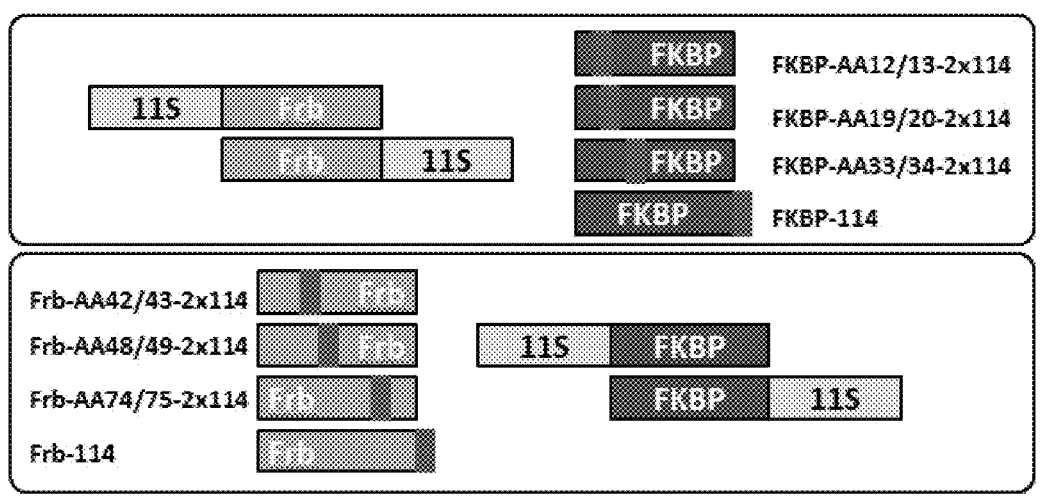
FIG. 13 depicts a schematic representation of FKBP/Frb fusion proteins. Shown are fusions of NLpoly11S fused to the C- or N-terminus of either FKBP or Frb, and the integration of the internal tag (NLpep114 tandem peptide=2×NLpep114) at different position within FKBP or Frb. The position of the integration site of the internal tag is indicated by the flanking amino acid positions of the host protein (e.g., AA12/13 indicates integration of 2×NLpep114 between amino acid 12 and 13 of FKBP).

Experiments were conducted to demonstrate facilitated NANOLUC bioluminescence complementation using the binding pair, FKBP and Frb (FIG. 13).

All transfections were performed as reverse transfections by mixing the transfection complex with a suspension of cells prior to plating. Briefly, a transfection mix (sufficient for one 96-well plate) was made containing 500 ul OptiMEM, 5 ug DNA, and 15 uL Fugene HD (Promega). The DNA of the complementation pair (Frb-X/FKBP-Y) was at a ratio of 1:1

For the transfection, the DNA of the complementation pair was used either un-diluted or at a dilution of 1:50. Total DNA content was adjusted to 5 ug using pGEM3Z as carrier DNA.

The transfection mix was mixed by gentle vortexing and incubated for 5-10 min at room temperature prior to use.

Cells were harvested by trypsination, washed, and diluted to a concentration of $2 \times 10^5$ cells/ml in DMEM+10% FBS. For the transfection, 0.5 ml transfection mix was added to 10 ml of cell suspension. The cell suspension was then plated into wells of a white, 96-well tissue culture plate (100 uL per well) and incubated O/N at 37° C.

Figure 14:
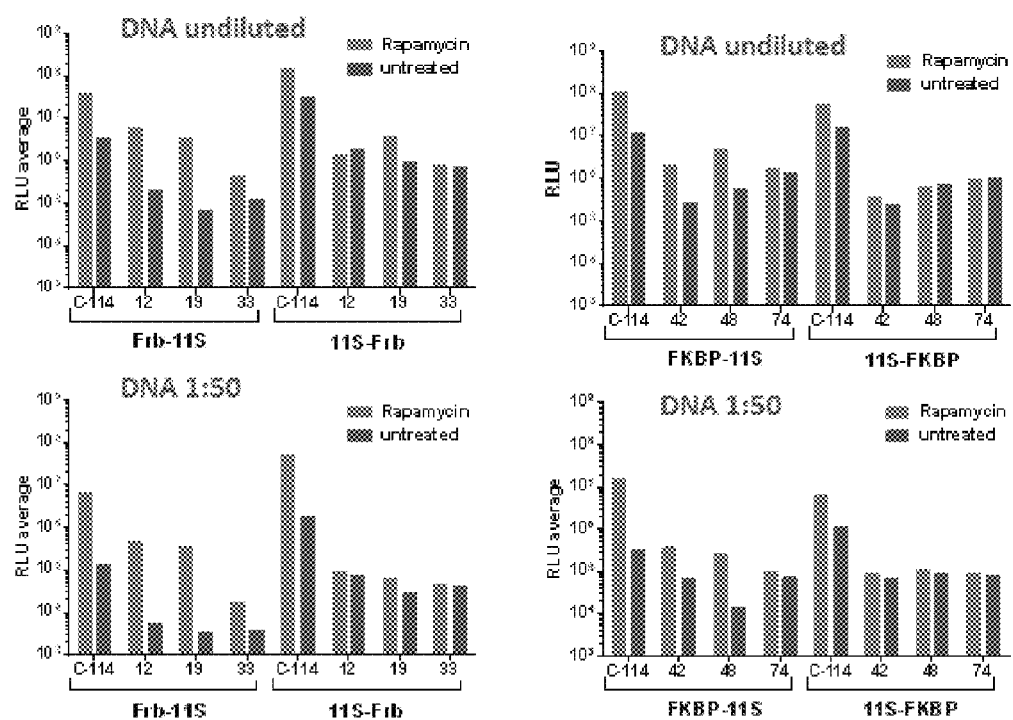
FIG. 14 demonstrates rapamycin-induced protein-protein interaction of FKBP/Frb using the internal tagging described herein. Position of the NLpep114 tandem peptide is indicated as C-terminal (C-114) or by the N-terminally flanking amino acid of the host protein (e.g. 12 indicates integration between AA12 and 13 within FKBP).
Figure 15:
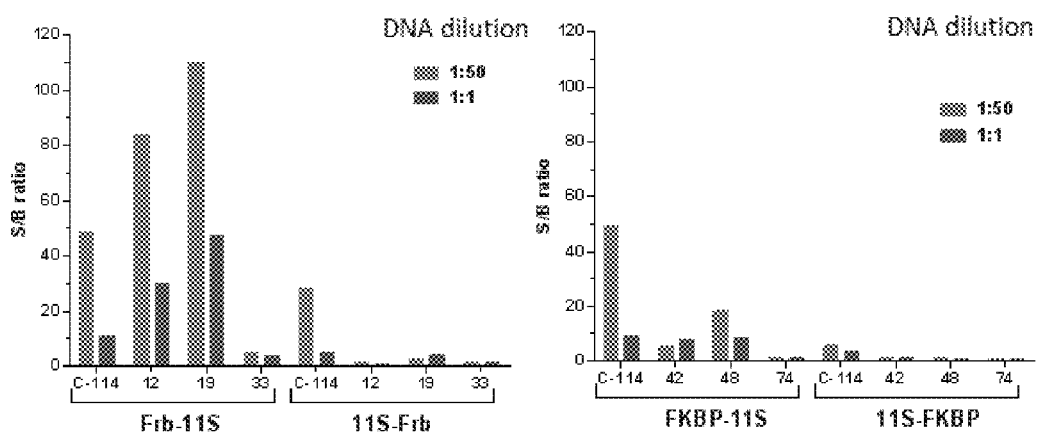
FIG. 15 demonstrates the conversion of the results shown in FIG. 15 into a relative change between untreated and rapamycin-treated sample (response ratio). The response ratio is calculated using the equation: response ratio=RLUrapamycin/RLUuntreated.
Figure 16:
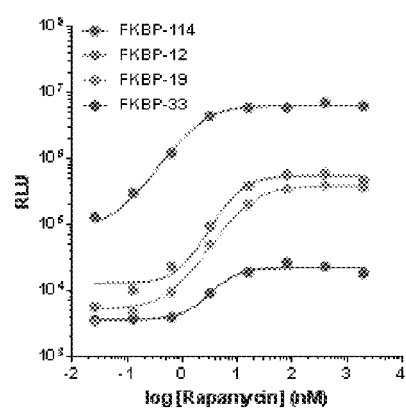
FIG. 16 demonstrates dose-dependent induction of the FKBP/Frb interaction by rapamycin using the internal tagging described herein.
Figure 16:
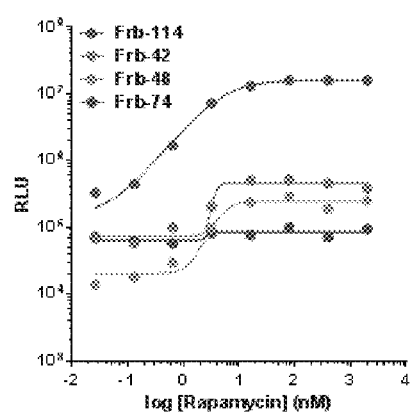
Figure 17:
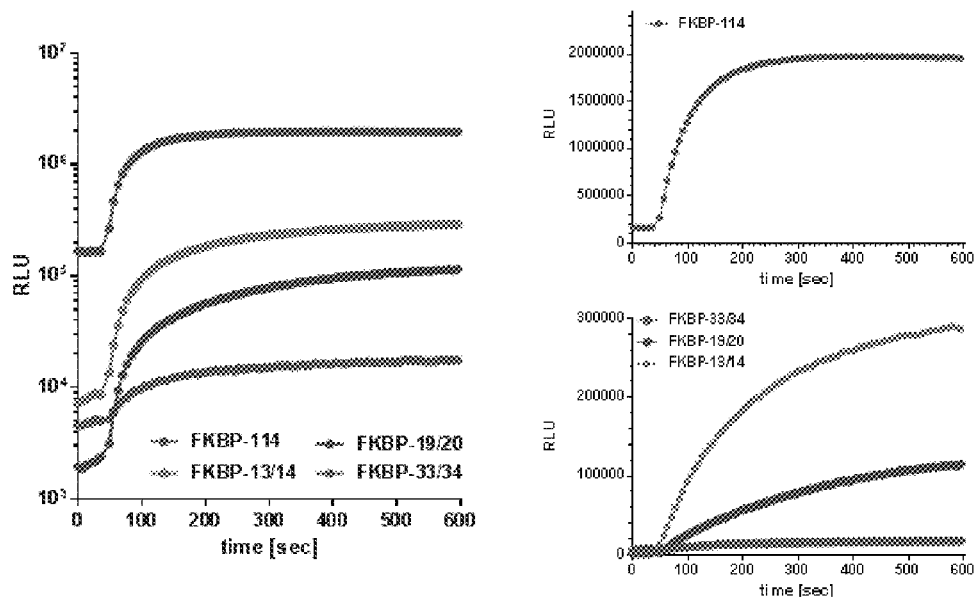
FIG. 17 demonstrates kinetic measurement of the rapamycin-induced FKBP/Frb interaction using the internal tagging described herein. All results are shown using Relative Light Units (RLU) as unit of measurement plotted either on a logarithmic (left) or linear scale (right).
Figure 18:
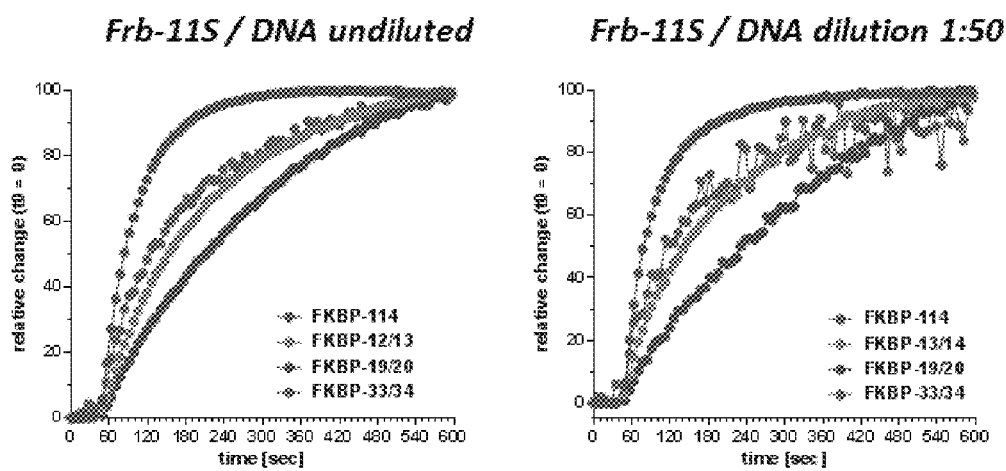
FIG. 18 demonstrates a normalized representation of results shown in FIG. 17 (left graph). For normalization, minimum and maximum values obtained for each individual trace were used as reference points (0% and 100% respectively).

Three different assays were performed on the transfected cells.

a) Endpoint assay using a single concentration of Rapamycin (FIGS. 14 and 15)
  Growth medium (DMEM+10% FBS) on the transfected cells was removed by aspiration, and 100 uL OptiMEM including Rapamycin (1 mM) and furimazine (10 mM) was added. The cells were incubated for 10 minutes at room temperature, and luminescence read on BMG Clariostar or Glomax Multi plus plate reader.

b) Endpoint assay-Rapamycin dose response (FIG. 16)
  Growth medium (DMEM+10% FBS) on the transfected cells was removed by aspiration, and 100 uL OptiMEM including a serial dilution of Rapamycin and furimazine (10 mM) was added. The cells were incubated for 10 minutes at room temperature, and luminescence read on BMG Clariostar or Glomax Multi plus plate reader.

c) Kinetic assay (FIGS. 17 and 18)
  Growth medium (DMEM+10% FBS) on the transfected cells was removed by aspiration, and 50 uL OptiMEM including furimazine (10 mM) was added. Luminescence detection was initiated on a BMG Clariostar plate reader, and 50 uL OptiMEM including Rapamycin (1 mM) and furimazine (10 mM) was injected onto the cells. Luminescence was continuously read.

Example 4

Internal High-Affinity NLpep finds use in a variety of embodiments. Cases arise in which neither the N-terminus nor the C-terminus represent attractive points for attachment of a protein tag. For example, 1) The protein terminus is not in the desired cellular localization. For instance, for a given membrane protein, it may be desired to have the tag on the extracellular side, but both termini are intracellular.

2) Terminal addition of a tag interrupts protein-protein interactions. For instance, many membrane proteins (such as ADRB2) have PDZ-binding motifs at their very C-terminus. Addition of a C-terminal tag would abolish these interactions and alter proper protein functioning.

3) It is desired for the tag to be placed spatially closer to a given site on the protein than the terminus allows.

4) N-terminal tag placement disrupts proper signal sequence function and cleavage.

5) The termini is already used for other tags or fusion proteins.

Example 5

Internal High-Affinity NLpep finds use in the measurement of surface expression of membrane proteins. It is commonly desired to measure the amount of a given protein expressed on the cell surface. This enables studies of:

Receptor activation and internalization
Receptor recycling from endosomes
Regulated exocytosis
Protein trafficking and secretion In some embodiments, the following experiments are configured so that purified an NLpoly, e.g., NLpoly11S, protein plus furimazine substrate can be added to the extracellular medium. Complementation with a high-affinity NLpep sequence, e.g., NLpep80, on the extracellular side of the plasma membrane can lead to spontaneous complementation, giving a luminescent signal that is directly proportional to the amount of protein on the surface.

a) The F508del mutation of the cystic fibrosis transmembrane conductance regulator (CFTR) is the most common cause of cystic fibrosis, and it prevents the protein from being correctly targeted to the plasma membrane, so it is instead degraded. Small molecule chaperones have been identified that can promote increased trafficking to the surface. To screen for such small molecules, it is beneficial to have a simple luminescent assay for quantifying surface expression of CFTR.

Tagging CFTR with the high-affinity NLpep allows quantification of surface expression, but both the N- and C-termini of CFTR are intracellular. Therefore, the NLpep tag is placed in one of the extracellular loops of the protein. In some embodiments, a Flag epitope tag is placed after residue Asn901 previously to provide an extracellular tag. Insertion of the high-affinity NLpep sequence at the same location in the F508del variant of CFTR allows one or more of the following:

1) Simple quantification of the amount of protein at the plasma membrane. Cells could be treated with compound libraries and positive control compounds known to promote proper trafficking, and the luminescence measured with live cells in the presence of a NLpoly, e.g., NLpoly11S, plus furimazine.

2) The cells are treated with a lytic reagent containing a NLpoly, e.g., NLpoly11S, plus furimazine in order to quantify the total amount of protein in the cell. Reduced protein degradation would increase the luminescent signal.

3) The glycosylation of CFTR that occurs during its maturation is easily detected as band shifting on a protein blot by addition of a NLpoly, e.g., NLpoly11S, plus furimazine in buffer to the blot membrane.

b) The trafficking of neurotransmitter receptors in and out of the plasma membrane is tightly regulated. AMPA receptors (AMPARs) mediate fast excitatory synaptic transmission, and synaptic strength is determined by the composition of AMPARs in the postsynaptic membrane, which is controlled by regulated trafficking of AMPAR subunits. Insertion of high-affinity NLpep into extracellular loops of AMPA receptors allows for straightforward measurement of protein levels and the kinetics of exocytosis and endocytosis.

All publications and patents mentioned in the above specification are herein incorporated by reference. Various modifications and variations of the described method and system of the invention will be apparent to those skilled in the art without departing from the scope and spirit of the invention. Although the invention has been described in connection with specific embodiments, it should be understood that the invention as claimed should not be unduly limited to such specific embodiments. Indeed, various modifications of the described modes for carrying out the invention that are obvious to those skilled in the relevant fields are intended to be within the scope of the present invention.

SEQUENCE LISTING (2579 sequences)

SEQ ID NO: 1 - DNA, 42 bp, Artificial Sequence
  Synthetic
atgggagtgaccggctggcggctgtgcgaacgcattctggcg

SEQ ID NO: 2 - protein, 14 aa, Artificial Sequence
  Synthetic
MGVTGWRLCERILA

SEQ ID NO: 3 - DNA, 42 bp, Artificial Sequence
  Synthetic
atggacgtgaccggctggcggctgtgcgaacgcattctggcg

SEQ ID NO: 4 - protein, 14 aa, Artificial Sequence
  Synthetic
MDVTGWRLCERILA

SEQ ID NO: 5 - DNA, 42 bp, Artificial Sequence
  Synthetic
atgggagtgaccgcctggcggctgtgcgaacgcattctggcg

SEQ ID NO: 6 - protein, 14 aa, Artificial Sequence
  Synthetic
MGVTAWRLCERILA

SEQ ID NO: 7 - DNA, 42 bp, Artificial Sequence
  Synthetic
atgggagtgaccggctggcggctgtgcaagcgcattctggcg

SEQ ID NO: 8 - protein, 14 aa, Artificial Sequence
  Synthetic
MGVTGWRLCKRILA

SEQ ID NO: 9 - DNA, 42 bp, Artificial Sequence
  Synthetic
atgggagtgaccggctggcggctgtgcgaacgcattagcgcg

SEQ ID NO: 10 - protein, 14 aa, Artificial Sequence
  Synthetic
MGVTGWRLCERISA

SEQ ID NO: 11 - DNA, 42 bp, Artificial Sequence
  Synthetic
atggacgtgaccggctggcggctgtgcaagcgcattagcgcg

SEQ ID NO: 12 - protein, 14 aa, Artificial Sequence
  Synthetic
MDVTGWRLCKRISA

SEQ ID NO: 13 - DNA, 42 bp, Artificial Sequence
  Synthetic
atggacgtgaccggctggcggctgtgcaagcgcattctggcg

SEQ ID NO: 14 - protein, 14 aa, Artificial Sequence
  Synthetic
MDVTGWRLCKRILA

SEQ ID NO: 15 - DNA, 42 bp, Artificial Sequence
  Synthetic
atggacgtgaccggctggcggctgtgcgaacgcattagcgcg

SEQ ID NO: 16 - protein, 14 aa, Artificial Sequence
  Synthetic
MDVTGWRLCERISA

SEQ ID NO: 17 - DNA, 42 bp, Artificial Sequence
  Synthetic
atgggagtgaccggctggcggctgtgcaagcgcattagcgcg

SEQ ID NO: 18 - protein, 14 aa, Artificial Sequence
  Synthetic
MGVTGWRLCKRISA

SEQ ID NO: 19 - DNA, 42 bp, Artificial Sequence
  Synthetic
atgggagtgaccggctggcggctgaacgaacgcattctggcg

SEQ ID NO: 20 - protein, 14 aa, Artificial Sequence
  Synthetic
MGVTGWRLNERILA

SEQ ID NO: 21 - DNA, 42 bp, Artificial Sequence
  Synthetic
atgggagtgaccggctggcggctgcaggaacgcattctggcg

SEQ ID NO: 22 - protein, 14 aa, Artificial Sequence
  Synthetic
MGVTGWRLQERILA

SEQ ID NO: 23 - DNA, 42 bp, Artificial Sequence
  Synthetic
atgggagtgaccggctggcggctgaagaagcgccggagccgg

SEQ ID NO: 24 - protein, 14 aa, Artificial Sequence
  Synthetic
MGVTGWRLKKRRSR

SEQ ID NO: 25 - DNA, 42 bp, Artificial Sequence
  Synthetic
atgaacgtgaccggctggcggctgtgcaagcgcattagcgcg

SEQ ID NO: 26 - protein, 14 aa, Artificial Sequence
  Synthetic
MNVTGWRLCKRISA

SEQ ID NO: 27 - DNA, 42 bp, Artificial Sequence
  Synthetic
atgagcgtgaccggctggcggctgtgcaagcgcattagcgcg

SEQ ID NO: 28 - protein, 14 aa, Artificial Sequence
  Synthetic
MSVTGWRLCKRISA

SEQ ID NO: 29 - DNA, 42 bp, Artificial Sequence
  Synthetic
atggaggtgaccggctggcggctgtgcaagcgcattagcgcg

SEQ ID NO: 30 - protein, 14 aa, Artificial Sequence
  Synthetic
MEVTGWRLCKRISA

SEQ ID NO: 31 - DNA, 42 bp, Artificial Sequence
  Synthetic
atgggcgtgaccggctggcggctgtgcaagcgcattagcgcg

SEQ ID NO: 32 - protein, 14 aa, Artificial Sequence
  Synthetic
MHVTGWRLCKRISA

SEQ ID NO: 33 - DNA, 42 bp, Artificial Sequence
  Synthetic
atgggacacaccggctggcggctgtgcaagcgcattagcgcg

SEQ ID NO: 34 - protein, 14 aa, Artificial Sequence
  Synthetic
MGITGWRLCKRISA

SEQ ID NO: 35 - DNA, 42 bp, Artificial Sequence
  Synthetic
atgggagccaccggctggcggctgtgcaagcgcattagcgcg

SEQ ID NO: 36 - protein, 14 aa, Artificial Sequence
  Synthetic
MGATGWRLCKRISA

SEQ ID NO: 37 - DNA, 42 bp, Artificial Sequence
  Synthetic
atgggaaagaccggctggcggctgtgcaagcgcattagcgcg

SEQ ID NO: 38 - protein, 14 aa, Artificial Sequence
  Synthetic
MGKTGWRLCKRISA

SEQ ID NO: 39 - DNA, 42 bp, Artificial Sequence
  Synthetic
atgggacagaccggctggcggctgtgcaagcgcattagcgcg

SEQ ID NO: 40 - protein, 14 aa, Artificial Sequence
  Synthetic
MGQTGWRLCKRISA

SEQ ID NO: 41 - DNA, 42 bp, Artificial Sequence
  Synthetic
atgggaagcaccggctggcggctgtgcaagcgcattagcgcg

SEQ ID NO: 42 - protein, 14 aa, Artificial Sequence
  Synthetic
MGSTGWRLCKRISA

SEQ ID NO: 43 - DNA, 42 bp, Artificial Sequence
  Synthetic
atgggagtggtgggctggcggctgtgcaagcgcattagcgcg

SEQ ID NO: 44 - protein, 14 aa, Artificial Sequence
  Synthetic
MGVVGWRLCKRISA

SEQ ID NO: 45 - DNA, 42 bp, Artificial Sequence
  Synthetic
atgggagtgaagggctggcggctgtgcaagcgcattagcgcg

SEQ ID NO: 46 - protein, 14 aa, Artificial Sequence
  Synthetic
MGVKGWRLCKRISA

SEQ ID NO: 47 - DNA, 42 bp, Artificial Sequence
  Synthetic
atgggagtgcagggctggcggctgtgcaagcgcattagcgcg

SEQ ID NO: 48 - protein, 14 aa, Artificial Sequence
  Synthetic
MGVQGWRLCKRISA

SEQ ID NO: 49 - DNA, 42 bp, Artificial Sequence
  Synthetic
atgggagtgaccggcacccggctgtgcaagcgcattagcgcg

SEQ ID NO: 50 - protein, 14 aa, Artificial Sequence
  Synthetic
MGVTGTRLCKRISA

SEQ ID NO: 51 - DNA, 42 bp, Artificial Sequence
  Synthetic
atgggagtgaccggcaagcggctgtgcaagcgcattagcgcg

SEQ ID NO: 52 - protein, 14 aa, Artificial Sequence
  Synthetic
MGVTGKRLCKRISA

SEQ ID NO: 53 - DNA, 42 bp, Artificial Sequence
  Synthetic
atgggagtgaccggcgtgcggctgtgcaagcgcattagcgcg

SEQ ID NO: 54 - protein, 14 aa, Artificial Sequence
  Synthetic
MGVTGVRLCKRISA

SEQ ID NO: 55 - DNA, 42 bp, Artificial Sequence
  Synthetic
atgggagtgaccggctggcggcactgcaagcgcattagcgcg

SEQ ID NO: 56 - protein, 14 aa, Artificial Sequence
  Synthetic
MGVTGWRICKRISA

SEQ ID NO: 57 - DNA, 42 bp, Artificial Sequence
  Synthetic
atgggagtgaccggctggcgggtgtgcaagcgcattagcgcg

SEQ ID NO: 58 - protein, 14 aa, Artificial Sequence
  Synthetic
MGVTGWRVCKRISA

SEQ ID NO: 59 - DNA, 42 bp, Artificial Sequence
  Synthetic
atgggagtgaccggctggcggacctgcaagcgcattagcgcg

SEQ ID NO: 60 - protein, 14 aa, Artificial Sequence
  Synthetic
MGVTGWRTCKRISA

SEQ ID NO: 61 - DNA, 42 bp, Artificial Sequence
  Synthetic
atgggagtgaccggctggcggtactgcaagcgcattagcgcg

SEQ ID NO: 62 - protein, 14 aa, Artificial Sequence
  Synthetic
MGVTGWRYCKRISA

SEQ ID NO: 63 - DNA, 42 bp, Artificial Sequence
  Synthetic
atgggagtgaccggctggcggaagtgcaagcgcattagcgcg

SEQ ID NO: 64 - protein, 14 aa, Artificial Sequence
  Synthetic
MGVTGWRKCKRISA

SEQ ID NO: 65 - DNA, 42 bp, Artificial Sequence
  Synthetic
atgggagtgaccggctggcggctgaacaagcgcattagcgcg

SEQ ID NO: 66 - protein, 14 aa, Artificial Sequence
  Synthetic
MGVTGWRLNKRISA

SEQ ID NO: 67 - DNA, 42 bp, Artificial Sequence
  Synthetic
atgggagtgaccggctggcggctgaccaagcgcattagcgcg

SEQ ID NO: 68 - protein, 14 aa, Artificial Sequence
  Synthetic
MGVTGWRLTKRISA

SEQ ID NO: 69 - DNA, 42 bp, Artificial Sequence
  Synthetic
atgggagtgaccggctggcggctgtgcaagaagattagcgcg

SEQ ID NO: 70 - protein, 14 aa, Artificial Sequence
  Synthetic
MGVTGWRLCKKISA

SEQ ID NO: 71 - DNA, 42 bp, Artificial Sequence
  Synthetic
atgggagtgaccggctggcggctgtgcaagaacattagcgcg

SEQ ID NO: 72 - protein, 14 aa, Artificial Sequence
  Synthetic
MGVTGWRLCKNISA

SEQ ID NO: 73 - DNA, 42 bp, Artificial Sequence
  Synthetic
atgggagtgaccggctggcggctgtgcaagcgcgtgagcgcg

SEQ ID NO: 74 - protein, 14 aa, Artificial Sequence
  Synthetic
MGVTGWRLCKRVSA

SEQ ID NO: 75 - DNA, 42 bp, Artificial Sequence
  Synthetic
atgggagtgaccggctggcggctgtgcaagcgccagagcgcg

SEQ ID NO: 76 - protein, 14 aa, Artificial Sequence
  Synthetic
MGVTGWRLCKRQSA

SEQ ID NO: 77 - DNA, 42 bp, Artificial Sequence
  Synthetic
atgggagtgaccggctggcggctgtgcaagcgcgagagcgcg

SEQ ID NO: 78 - protein, 14 aa, Artificial Sequence
  Synthetic
MGVTGWRLCKRESA

SEQ ID NO: 79 - DNA, 42 bp, Artificial Sequence
  Synthetic
atgggagtgaccggctggcggctgtgcaagcgccggagcgcg

SEQ ID NO: 80 - protein, 14 aa, Artificial Sequence
  Synthetic
MGVTGWRLCKRRSA

SEQ ID NO: 81 - DNA, 42 bp, Artificial Sequence
  Synthetic
atgggagtgaccggctggcggctgtgcaagcgcttcagcgcg

SEQ ID NO: 82 - protein, 14 aa, Artificial Sequence
  Synthetic
MGVTGWRLCKRFSA

SEQ ID NO: 83 - DNA, 42 bp, Artificial Sequence
  Synthetic
atgggagtgaccggctggcggctgtgcaagcgcattagcaac

SEQ ID NO: 84 - protein, 14 aa, Artificial Sequence
  Synthetic
MGVTGWRLCKRISN

SEQ ID NO: 85 - DNA, 42 bp, Artificial Sequence
  Synthetic
atgggagtgaccggctggcggctgtgcaagcgcattagcacc

SEQ ID NO: 86 - protein, 14 aa, Artificial Sequence
  Synthetic
MGVTGWRLCKRIST

SEQ ID NO: 87 - DNA, 42 bp, Artificial Sequence
  Synthetic
atgggagtgaccggctggcggctgtgcaagcgcattagccgg

SEQ ID NO: 88 - protein, 14 aa, Artificial Sequence
  Synthetic
MGVTGWRLCKRISR

SEQ ID NO: 89 - DNA, 42 bp, Artificial Sequence
  Synthetic
atgggagtgaccggctggcggctgtgcaagcgcattagcctg

SEQ ID NO: 90 - protein, 14 aa, Artificial Sequence
  Synthetic
MGVTGWRLCKRISL

SEQ ID NO: 91 - DNA, 42 bp, Artificial Sequence
  Synthetic
atgggagtgaccggctggcggctgtgcaagcgcattagcgag

SEQ ID NO: 92 - protein, 14 aa, Artificial Sequence
  Synthetic
MGVTGWRLCKRISE

SEQ ID NO: 93 - DNA, 42 bp, Artificial Sequence
  Synthetic
atgggagtgaccggcttccggctgtgcaagcgcattagcgcg

SEQ ID NO: 94 - protein, 14 aa, Artificial Sequence
  Synthetic
MGVTGFRLCKRISA

SEQ ID NO: 95 - DNA, 42 bp, Artificial Sequence
  Synthetic
atgggagtgaccggctaccggctgtgcaagcgcattagcgcg

SEQ ID NO: 96 - protein, 14 aa, Artificial Sequence
  Synthetic
MGVTGYRLCKRISA

SEQ ID NO: 97 - DNA, 42 bp, Artificial Sequence
  Synthetic
atgggagtgaccggcgagcggctgtgcaagcgcattagcgcg

SEQ ID NO: 98 - protein, 14 aa, Artificial Sequence
  Synthetic
MGVTGERLCKRISA

SEQ ID NO: 99 - DNA, 42 bp, Artificial Sequence
  Synthetic
atgcaggtgaccggctggcggctgtgcaagcgcattagcgcg

SEQ ID NO: 100 - protein, 14 aa, Artificial Sequence
  Synthetic
MQVTGWRLCKRISA

SEQ ID NO: 101 - DNA, 42 bp, Artificial Sequence
  Synthetic
atgaccgtgaccggctggcggctgtgcaagcgcattagcgcg

SEQ ID NO: 102 - protein, 14 aa, Artificial Sequence
  Synthetic
MTVTGWRLCKRISA

SEQ ID NO: 103 - DNA, 42 bp, Artificial Sequence
  Synthetic
atgggagtggagggctggcggctgtgcaagcgcattagcgcg

SEQ ID NO: 104 - protein, 14 aa, Artificial Sequence
  Synthetic
MGVEGWRLCKRISA

SEQ ID NO: 105 - DNA, 42 bp, Artificial Sequence
  Synthetic
atgggagtgaccggctggcggctgttcaagcgcattagcgcg

SEQ ID NO: 106 - protein, 14 aa, Artificial Sequence
  Synthetic
MGVTGWRLFKRISA

SEQ ID NO: 107 - DNA, 42 bp, Artificial Sequence
  Synthetic
atgggagtgaccggctggcggctgtacaagcgcattagcgcg

SEQ ID NO: 108 - protein, 14 aa, Artificial Sequence
  Synthetic
MGVTGWRLYKRISA

SEQ ID NO: 109 - DNA, 42 bp, Artificial Sequence
  Synthetic
atgggagtgaccggctggcggctgagcaagcgcattagcgcg

SEQ ID NO: 110 - protein, 14 aa, Artificial Sequence
  Synthetic
MGVTGWRLSKRISA

SEQ ID NO: 111 - DNA, 42 bp, Artificial Sequence
  Synthetic
atgggagtgaccggctggcggctgggcaagcgcattagcgcg

SEQ ID NO: 112 - protein, 14 aa, Artificial Sequence
  Synthetic
MGVTGWRLHKRISA

SEQ ID NO: 113 - DNA, 42 bp, Artificial Sequence
  Synthetic
atgggagtgaccggctggcggctgatgaagcgcattagcgcg

SEQ ID NO: 114 - protein, 14 aa, Artificial Sequence
  Synthetic
MGVTGWRLMKRISA

SEQ ID NO: 115 - DNA, 42 bp, Artificial Sequence
  Synthetic
atgggagtgaccggctggcggctggccaagcgcattagcgcg

SEQ ID NO: 116 - protein, 14 aa, Artificial Sequence
  Synthetic
MGVTGWRLAKRISA

SEQ ID NO: 117 - DNA, 42 bp, Artificial Sequence
  Synthetic
atgggagtgaccggctggcggctgcagaagcgcattagcgcg

SEQ ID NO: 118 - protein, 14 aa, Artificial Sequence
  Synthetic
MGVTGWRLQKRISA

SEQ ID NO: 119 - DNA, 42 bp, Artificial Sequence
  Synthetic
atgggagtgaccggctggcggctgctgaagcgcattagcgcg

SEQ ID NO: 120 - protein, 14 aa, Artificial Sequence
  Synthetic
MGVTGWRLLKRISA

SEQ ID NO: 121 - DNA, 42 bp, Artificial Sequence
  Synthetic
atgggagtgaccggctggcggctgaagaagcgcattagcgcg

SEQ ID NO: 122 - protein, 14 aa, Artificial Sequence
  Synthetic
MGVTGWRLKKRISA

SEQ ID NO: 123 - DNA, 42 bp, Artificial Sequence
  Synthetic
atgaaccacaccggctggcggctgaacaagaaggtgagcaac

SEQ ID NO: 124 - protein, 14 aa, Artificial Sequence
  Synthetic
MNITGWRLNKKVSN

SEQ ID NO: 125 - DNA, 42 bp, Artificial Sequence
  Synthetic
atgaaccacaccggctaccggctgaacaagaaggtgagcaac

SEQ ID NO: 126 - protein, 14 aa, Artificial Sequence
  Synthetic
MNITGYRLNKKVSN

SEQ ID NO: 127 - DNA, 42 bp, Artificial Sequence
  Synthetic
atgtgcgtgaccggctggcggctgttcaagcgcattagcgcg

SEQ ID NO: 128 - protein, 14 aa, Artificial Sequence
  Synthetic
MCVTGWRLFKRISA

SEQ ID NO: 129 - DNA, 42 bp, Artificial Sequence
  Synthetic
atgcccgtgaccggctggcggctgttcaagcgcattagcgcg

SEQ ID NO: 130 - protein, 14 aa, Artificial Sequence
  Synthetic
MPVTGWRLFKRISA

SEQ ID NO: 131 - DNA, 42 bp, Artificial Sequence
  Synthetic
atgaaccacaccggctaccggctgttcaagaaggtgagcaac

SEQ ID NO: 132 - protein, 14 aa, Artificial Sequence
  Synthetic
MNITGYRLFKKVSN

SEQ ID NO: 133 - DNA, 42 bp, Artificial Sequence
  Synthetic
atgaacgtgaccggctaccggctgttcaagaaggtgagcaac

SEQ ID NO: 134 - protein, 14 aa, Artificial Sequence
  Synthetic
MNVTGYRLFKKVSN

SEQ ID NO: 135 - DNA, 42 bp, Artificial Sequence
  Synthetic
atgaacgtgaccggctggcggctgttcaagaaggtgagcaac

SEQ ID NO: 136 - protein, 14 aa, Artificial Sequence
  Synthetic
MNVTGWRLFKKVSN

SEQ ID NO: 137 - DNA, 42 bp, Artificial Sequence
  Synthetic
atgaacgtgaccggctggcggctgttcaagaagattagcaac

SEQ ID NO: 138 - protein, 14 aa, Artificial Sequence
  Synthetic
MNVTGWRLFKKISN

SEQ ID NO: 139 - DNA, 42 bp, Artificial Sequence
  Synthetic
atgaacgtgaccggctggcggctgttcaagcgcattagcaac

SEQ ID NO: 140 - protein, 14 aa, Artificial Sequence
  Synthetic
MNVTGWRLFKRISN

SEQ ID NO: 141 - DNA, 42 bp, Artificial Sequence
  Synthetic
atgggagtgaccggctggcggctgttcaagcgcattagcaac

SEQ ID NO: 142 - protein, 14 aa, Artificial Sequence
  Synthetic
MGVTGWRLFKRISN

SEQ ID NO: 143 - DNA, 42 bp, Artificial Sequence
  Synthetic
atgaacgtgaccggctggcggctgttcgaacgcattagcaac

SEQ ID NO: 144 - protein, 14 aa, Artificial Sequence
  Synthetic
MNVTGWRLFERISN

SEQ ID NO: 145 - DNA, 42 bp, Artificial Sequence
  Synthetic
atgaacgtgaccggctggcggctgttcaagcgcattctgaac

SEQ ID NO: 146 - protein, 14 aa, Artificial Sequence
  Synthetic
MNVTGWRLFKRILN

SEQ ID NO: 147 - DNA, 42 bp, Artificial Sequence
  Synthetic
atgaacgtgaccggctggcggctgttcaagcgcattagcgcg

SEQ ID NO: 148 - protein, 14 aa, Artificial Sequence
  Synthetic
MNVTGWRLFKRISA

SEQ ID NO: 149 - DNA, 42 bp, Artificial Sequence
  Synthetic
atgaacgtgaccggctggcggctgttcgaaaagattagcaac

SEQ ID NO: 150 - protein, 14 aa, Artificial Sequence
  Synthetic
MNVTGWRLFEKISN

SEQ ID NO: 151 - DNA, 42 bp, Artificial Sequence
  Synthetic
atgaacgtgagcggctggcggctgttcgaaaagattagcaac

SEQ ID NO: 152 - protein, 14 aa, Artificial Sequence
  Synthetic
MNVSGWRLFEKISN

SEQ ID NO: 153 - DNA, 39 bp, Artificial Sequence
  Synthetic
atggtgaccggctggcggctgttcaagaagattagcaac

SEQ ID NO: 154 - protein, 13 aa, Artificial Sequence
  Synthetic
MVTGWRLFKKISN

SEQ ID NO: 155 - DNA, 42 bp, Artificial Sequence
  Synthetic
atgaacgtgagcggctggcggctgttcaagaagattagcaac

SEQ ID NO: 156 - protein, 14 aa, Artificial Sequence
  Synthetic
MNVSGWRLFKKISN

SEQ ID NO: 157 - DNA, 42 bp, Artificial Sequence
  Synthetic
atgaacgtgaccggctaccggctgttcaagaagattagcaac

SEQ ID NO: 158 - protein, 14 aa, Artificial Sequence
  Synthetic
MNVTGYRLFKKISN

SEQ ID NO: 159 - DNA, 39 bp, Artificial Sequence
  Synthetic
atggtgagcggctggcggctgttcaagaagattagcaac

SEQ ID NO: 160 - protein, 13 aa, Artificial Sequence
  Synthetic
MVSGWRLFKKISN

SEQ ID NO: 161 - DNA, 36 bp, Artificial Sequence
  Synthetic
atgagcggctggcggctgttcaagaagattagcaac

SEQ ID NO: 162 - protein, 12 aa, Artificial Sequence
  Synthetic
MSGWRLFKKISN

SEQ ID NO: 163 - DNA, 33 bp, Artificial Sequence
  Synthetic
atgggctggcggctgttcaagaagattagcaac

SEQ ID NO: 164 - protein, 11 aa, Artificial Sequence
  Synthetic
MGWRLFKKISN

SEQ ID NO: 165 - DNA, 39 bp, Artificial Sequence
  Synthetic
atgaacgtgagcggctggcggctgttcaagaagattagc

SEQ ID NO: 166 - protein, 13 aa, Artificial Sequence
  Synthetic
MNVSGWRLFKKIS

SEQ ID NO: 167 - DNA, 36 bp, Artificial Sequence
  Synthetic
atgaacgtgagcggctggcggctgttcaagaagatt

SEQ ID NO: 168 - protein, 12 aa, Artificial Sequence
  Synthetic
MNVSGWRLFKKI

SEQ ID NO: 169 - DNA, 33 bp, Artificial Sequence
  Synthetic
atgaacgtgagcggctggcggctgttcaagaag

SEQ ID NO: 170 - protein, 11 aa, Artificial Sequence
  Synthetic
MNVSGWRLFKK

SEQ ID NO: 171 - DNA, 36 bp, Artificial Sequence
  Synthetic
atggtgagcggctggcggctgttcaagaagattagc

SEQ ID NO: 172 - protein, 12 aa, Artificial Sequence
  Synthetic
MVSGWRLFKKIS

SEQ ID NO: 173 - DNA, 30 bp, Artificial Sequence
  Synthetic
atgagcggctggcggctgttcaagaagatt

SEQ ID NO: 174 - protein, 10 aa, Artificial Sequence
  Synthetic
MSGWRLFKKI

SEQ ID NO: 175 - DNA, 42 bp, Artificial Sequence
  Synthetic
atgaacgtgagcggctggggcctgttcaagaagattagcaac

SEQ ID NO: 176 - protein, 14 aa, Artificial Sequence
  Synthetic
MNVSGWGLFKKISN

SEQ ID NO: 177 - DNA, 42 bp, Artificial Sequence
  Synthetic
atgcccgtgagcggctggcggctgttcaagaagattagcaac

SEQ ID NO: 178 - protein, 14 aa, Artificial Sequence
  Synthetic
MPVSGWRLFKKISN

SEQ ID NO: 179 - DNA, 45 bp, Artificial Sequence
  Synthetic
atgaaccccgtgagcggctggcggctgttcaagaagattagcaac

SEQ ID NO: 180 - protein, 15 aa, Artificial Sequence
  Synthetic
MNPVSGWRLFKKISN

SEQ ID NO: 181 - DNA, 48 bp, Artificial Sequence
  Synthetic
atgatcaaccccgtgagcggctggcggctgttcaagaagattagcaac

SEQ ID NO: 182 - protein, 16 aa, Artificial Sequence
  Synthetic
MINPVSGWRLFKKISN

SEQ ID NO: 183 - DNA, 51 bp, Artificial Sequence
  Synthetic
atgaccatcaaccccgtgagcggctggcggctgttcaagaagattagcaac

SEQ ID NO: 184 - protein, 17 aa, Artificial Sequence
  Synthetic
MTINPVSGWRLFKKISN

SEQ ID NO: 185 - DNA, 54 bp, Artificial Sequence
  Synthetic
atggtgaccatcaaccccgtgagcggctggcggctgttcaagaagattagcaac

SEQ ID NO: 186 - protein, 18 aa, Artificial Sequence
  Synthetic
MVTINPVSGWRLFKKISN

SEQ ID NO: 187 - DNA, 57 bp, Artificial Sequence
  Synthetic
atgcgggtgaccatcaaccccgtgagcggctggcggctgttcaagaagattagcaac

SEQ ID NO: 188 - protein, 19 aa, Artificial Sequence
  Synthetic
MRVTINPVSGWRLFKKISN

SEQ ID NO: 189 - DNA, 30 bp, Artificial Sequence
  Synthetic
atgagcggctggcggctgctgaagaagatt

SEQ ID NO: 190 - protein, 10 aa, Artificial Sequence
  Synthetic
MSGWRLLKKI

SEQ ID NO: 191 - DNA, 30 bp, Artificial Sequence
  Synthetic
atgaccggctaccggctgctgaagaagatt

SEQ ID NO: 192 - protein, 10 aa, Artificial Sequence
  Synthetic
MTGYRLLKKI

SEQ ID NO: 193 - DNA, 27 bp, Artificial Sequence
  Synthetic
atgagcggctggcggctgttcaagaag

SEQ ID NO: 194 - protein, 9 aa, Artificial Sequence
  Synthetic
MSGWRLFKK

SEQ ID NO: 195 - DNA, 36 bp, Artificial Sequence
  Synthetic
atggtgaccggctaccggctgttcaagaagattagc

SEQ ID NO: 196 - protein, 12 aa, Artificial Sequence
  Synthetic
MVTGYRLFKKIS

SEQ ID NO: 197 - DNA, 36 bp, Artificial Sequence
  Synthetic
atggtgaccggctaccggctgttcgagaagattagc

SEQ ID NO: 198 - protein, 12 aa, Artificial Sequence
  Synthetic
MVTGYRLFEKIS

SEQ ID NO: 199 - DNA, 36 bp, Artificial Sequence
  Synthetic
atggtgaccggctaccggctgttcgagcagattagc

SEQ ID NO: 200 - protein, 12 aa, Artificial Sequence
  Synthetic
MVTGYRLFEQIS

SEQ ID NO: 201 - DNA, 36 bp, Artificial Sequence
  Synthetic
atggtgaccggctaccggctgttcgagaaggagagc

SEQ ID NO: 202 - protein, 12 aa, Artificial Sequence
  Synthetic
MVTGYRLFEKES

SEQ ID NO: 203 - DNA, 36 bp, Artificial Sequence
  Synthetic
atggtgaccggctaccggctgttcgagcaggagagc

SEQ ID NO: 204 - protein, 12 aa, Artificial Sequence
  Synthetic
MVTGYRLFEQES

SEQ ID NO: 205 - DNA, 36 bp, Artificial Sequence
  Synthetic
atggtgaccggctaccggctgttcgagcaggagctg

SEQ ID NO: 206 - protein, 12 aa, Artificial Sequence
  Synthetic
MVTGYRLFEQEL

SEQ ID NO: 207 - DNA, 36 bp, Artificial Sequence
  Synthetic
atggtggagggctaccggctgttcgagaagattagc

SEQ ID NO: 208 - protein, 12 aa, Artificial Sequence
  Synthetic
MVEGYRLFEKIS

SEQ ID NO: 209 - DNA, 36 bp, Artificial Sequence
  Synthetic
atggtggagggctaccggctgttcgagcagattagc

SEQ ID NO: 210 - protein, 12 aa, Artificial Sequence
  Synthetic
MVEGYRLFEQIS

SEQ ID NO: 211 - DNA, 36 bp, Artificial Sequence
  Synthetic
atggtggagggctaccggctgttcgagaaggagagc

SEQ ID NO: 212 - protein, 12 aa, Artificial Sequence
  Synthetic
MVEGYRLFEKES

SEQ ID NO: 213 - DNA, 36 bp, Artificial Sequence
  Synthetic
atggtggagggctaccggctgttcgagcaggagagc

SEQ ID NO: 214 - protein, 12 aa, Artificial Sequence
  Synthetic
MVEGYRLFEQES

SEQ ID NO: 215 - DNA, 36 bp, Artificial Sequence
  Synthetic
atggtggagggctaccggctgttcgagcaggagctg

SEQ ID NO: 216 - protein, 12 aa, Artificial Sequence
  Synthetic
MVEGYRLFEQEL

SEQ ID NO: 217 - DNA, 36 bp, Artificial Sequence
  Synthetic
atgattagcggctggcggctgatgaagaacattagc

SEQ ID NO: 218 - protein, 12 aa, Artificial Sequence
  Synthetic
MISGWRLMKNIS

SEQ ID NO: 219 - DNA, 36 bp, Artificial Sequence
  Synthetic
atggtggagggctaccggctgttcaagaagattagc

SEQ ID NO: 220 - protein, 12 aa, Artificial Sequence
  Synthetic
MVEGYRLFKKIS

SEQ ID NO: 221 - DNA, 39 bp, Artificial Sequence
  Synthetic
gacgtgaccggctggcggctgtgcgaacgcattctggcg

SEQ ID NO: 222 - protein, 13 aa, Artificial Sequence
  Synthetic
DVTGWRLCERILA

SEQ ID NO: 223 - DNA, 39 bp, Artificial Sequence
  Synthetic
ggagtgaccgcctggcggctgtgcgaacgcattctggcg

SEQ ID NO: 224 - protein, 13 aa, Artificial Sequence
  Synthetic
GVTAWRLCERILA

SEQ ID NO: 225 - DNA, 39 bp, Artificial Sequence
  Synthetic
ggagtgaccggctggcggctgtgcaagcgcattctggcg

SEQ ID NO: 226 - protein, 13 aa, Artificial Sequence
  Synthetic
GVTGWRLCKRILA

SEQ ID NO: 227 - DNA, 39 bp, Artificial Sequence
  Synthetic
ggagtgaccggctggcggctgtgcgaacgcattagcgcg

SEQ ID NO: 228 - protein, 13 aa, Artificial Sequence
  Synthetic
GVTGWRLCERISA

SEQ ID NO: 229 - DNA, 39 bp, Artificial Sequence
  Synthetic
gacgtgaccggctggcggctgtgcaagcgcattagcgcg

SEQ ID NO: 230 - protein, 13 aa, Artificial Sequence
  Synthetic
DVTGWRLCKRISA

SEQ ID NO: 231 - DNA, 39 bp, Artificial Sequence
  Synthetic
gacgtgaccggctggcggctgtgcaagcgcattctggcg

SEQ ID NO: 232 - protein, 13 aa, Artificial Sequence
  Synthetic
DVTGWRLCKRILA

SEQ ID NO: 233 - DNA, 39 bp, Artificial Sequence
  Synthetic
gacgtgaccggctggcggctgtgcgaacgcattagcgcg

SEQ ID NO: 234 - protein, 13 aa, Artificial Sequence
  Synthetic
DVTGWRLCERISA

SEQ ID NO: 235 - DNA, 39 bp, Artificial Sequence
  Synthetic
ggagtgaccggctggcggctgtgcaagcgcattagcgcg

SEQ ID NO: 236 - protein, 13 aa, Artificial Sequence
  Synthetic
GVTGWRLCKRISA

SEQ ID NO: 237 - DNA, 39 bp, Artificial Sequence
  Synthetic
ggagtgaccggctggcggctgaacgaacgcattctggcg

SEQ ID NO: 238 - protein, 13 aa, Artificial Sequence
  Synthetic
GVTGWRLNERILA

SEQ ID NO: 239 - DNA, 39 bp, Artificial Sequence
  Synthetic
ggagtgaccggctggcggctgcaggaacgcattctggcg

SEQ ID NO: 240 - protein, 13 aa, Artificial Sequence
  Synthetic
GVTGWRLQERILA

SEQ ID NO: 241 - DNA, 39 bp, Artificial Sequence
  Synthetic
ggagtgaccggctggcggctgaagaagcgccggagccgg

SEQ ID NO: 242 - protein, 13 aa, Artificial Sequence
  Synthetic
GVTGWRLKKRRSR

SEQ ID NO: 243 - DNA, 39 bp, Artificial Sequence
  Synthetic
aacgtgaccggctggcggctgtgcaagcgcattagcgcg

SEQ ID NO: 244 - protein, 13 aa, Artificial Sequence
  Synthetic
NVTGWRLCKRISA

SEQ ID NO: 245 - DNA, 39 bp, Artificial Sequence
  Synthetic
agcgtgaccggctggcggctgtgcaagcgcattagcgcg

SEQ ID NO: 246 - protein, 13 aa, Artificial Sequence
  Synthetic
SVTGWRLCKRISA

SEQ ID NO: 247 - DNA, 39 bp, Artificial Sequence
  Synthetic
gaggtgaccggctggcggctgtgcaagcgcattagcgcg

SEQ ID NO: 248 - protein, 13 aa, Artificial Sequence
  Synthetic
EVTGWRLCKRISA

SEQ ID NO: 249 - DNA, 39 bp, Artificial Sequence
  Synthetic
ggcgtgaccggctggcggctgtgcaagcgcattagcgcg

SEQ ID NO: 250 - protein, 13 aa, Artificial Sequence
  Synthetic
HVTGWRLCKRISA

SEQ ID NO: 251 - DNA, 39 bp, Artificial Sequence
  Synthetic
ggacacaccggctggcggctgtgcaagcgcattagcgcg

SEQ ID NO: 252 - protein, 13 aa, Artificial Sequence
  Synthetic
GITGWRLCKRISA

SEQ ID NO: 253 - DNA, 39 bp, Artificial Sequence
  Synthetic
ggagccaccggctggcggctgtgcaagcgcattagcgcg

SEQ ID NO: 254 - protein, 13 aa, Artificial Sequence
  Synthetic
GATGWRLCKRISA

SEQ ID NO: 255 - DNA, 39 bp, Artificial Sequence
  Synthetic
ggaaagaccggctggcggctgtgcaagcgcattagcgcg

SEQ ID NO: 256 - protein, 13 aa, Artificial Sequence
  Synthetic
GKTGWRLCKRISA

SEQ ID NO: 257 - DNA, 39 bp, Artificial Sequence
  Synthetic
ggacagaccggctggcggctgtgcaagcgcattagcgcg

SEQ ID NO: 258 - protein, 13 aa, Artificial Sequence
  Synthetic
GQTGWRLCKRISA

SEQ ID NO: 259 - DNA, 39 bp, Artificial Sequence
  Synthetic
ggaagcaccggctggcggctgtgcaagcgcattagcgcg

SEQ ID NO: 260 - protein, 13 aa, Artificial Sequence
  Synthetic
GSTGWRLCKRISA

SEQ ID NO: 261 - DNA, 39 bp, Artificial Sequence
  Synthetic
ggagtggtgggctggcggctgtgcaagcgcattagcgcg

SEQ ID NO: 262 - protein, 13 aa, Artificial Sequence
  Synthetic
GVVGWRLCKRISA

SEQ ID NO: 263 - DNA, 39 bp, Artificial Sequence
  Synthetic
ggagtgaagggctggcggctgtgcaagcgcattagcgcg

SEQ ID NO: 264 - protein, 13 aa, Artificial Sequence
  Synthetic
GVKGWRLCKRISA

SEQ ID NO: 265 - DNA, 39 bp, Artificial Sequence
  Synthetic
ggagtgcagggctggcggctgtgcaagcgcattagcgcg

SEQ ID NO: 266 - protein, 13 aa, Artificial Sequence
  Synthetic
GVQGWRLCKRISA

SEQ ID NO: 267 - DNA, 39 bp, Artificial Sequence
  Synthetic
ggagtgaccggcacccggctgtgcaagcgcattagcgcg

SEQ ID NO: 268 - protein, 13 aa, Artificial Sequence
  Synthetic
GVTGTRLCKRISA

SEQ ID NO: 269 - DNA, 39 bp, Artificial Sequence
  Synthetic
ggagtgaccggcaagcggctgtgcaagcgcattagcgcg

SEQ ID NO: 270 - protein, 13 aa, Artificial Sequence
  Synthetic
GVTGKRLCKRISA

SEQ ID NO: 271 - DNA, 39 bp, Artificial Sequence
  Synthetic
ggagtgaccggcgtgcggctgtgcaagcgcattagcgcg

SEQ ID NO: 272 - protein, 13 aa, Artificial Sequence
  Synthetic
GVTGVRLCKRISA

SEQ ID NO: 273 - DNA, 39 bp, Artificial Sequence
  Synthetic
ggagtgaccggctggcggcactgcaagcgcattagcgcg

SEQ ID NO: 274 - protein, 13 aa, Artificial Sequence
  Synthetic
GVTGWRICKRISA

SEQ ID NO: 275 - DNA, 39 bp, Artificial Sequence
  Synthetic
ggagtgaccggctggcgggtgtgcaagcgcattagcgcg

SEQ ID NO: 276 - protein, 13 aa, Artificial Sequence
  Synthetic
GVTGWRVCKRISA

SEQ ID NO: 277 - DNA, 39 bp, Artificial Sequence
  Synthetic
ggagtgaccggctggcggacctgcaagcgcattagcgcg

SEQ ID NO: 278 - protein, 13 aa, Artificial Sequence
  Synthetic
GVTGWRTCKRISA

SEQ ID NO: 279 - DNA, 39 bp, Artificial Sequence
  Synthetic
ggagtgaccggctggcggtactgcaagcgcattagcgcg

SEQ ID NO: 280 - protein, 13 aa, Artificial Sequence
  Synthetic
GVTGWRYCKRISA

SEQ ID NO: 281 - DNA, 39 bp, Artificial Sequence
  Synthetic
ggagtgaccggctggcggaagtgcaagcgcattagcgcg

SEQ ID NO: 282 - protein, 13 aa, Artificial Sequence
  Synthetic
GVTGWRKCKRISA

SEQ ID NO: 283 - DNA, 39 bp, Artificial Sequence
  Synthetic
ggagtgaccggctggcggctgaacaagcgcattagcgcg

SEQ ID NO: 284 - protein, 13 aa, Artificial Sequence
  Synthetic
GVTGWRLNKRISA

SEQ ID NO: 285 - DNA, 39 bp, Artificial Sequence
  Synthetic
ggagtgaccggctggcggctgaccaagcgcattagcgcg

SEQ ID NO: 286 - protein, 13 aa, Artificial Sequence
  Synthetic
GVTGWRLTKRISA

SEQ ID NO: 287 - DNA, 39 bp, Artificial Sequence
  Synthetic
ggagtgaccggctggcggctgtgcaagaagattagcgcg

SEQ ID NO: 288 - protein, 13 aa, Artificial Sequence
  Synthetic
GVTGWRLCKKISA

SEQ ID NO: 289 - DNA, 39 bp, Artificial Sequence
  Synthetic
ggagtgaccggctggcggctgtgcaagaacattagcgcg

SEQ ID NO: 290 - protein, 13 aa, Artificial Sequence
  Synthetic
GVTGWRLCKNISA

SEQ ID NO: 291 - DNA, 39 bp, Artificial Sequence
  Synthetic
ggagtgaccggctggcggctgtgcaagcgcgtgagcgcg

SEQ ID NO: 292 - protein, 13 aa, Artificial Sequence
  Synthetic
GVTGWRLCKRVSA

SEQ ID NO: 293 - DNA, 39 bp, Artificial Sequence
  Synthetic
ggagtgaccggctggcggctgtgcaagcgccagagcgcg

SEQ ID NO: 294 - protein, 13 aa, Artificial Sequence
  Synthetic
GVTGWRLCKRQSA

SEQ ID NO: 295 - DNA, 39 bp, Artificial Sequence
  Synthetic
ggagtgaccggctggcggctgtgcaagcgcgagagcgcg

SEQ ID NO: 296 - protein, 13 aa, Artificial Sequence
  Synthetic
GVTGWRLCKRESA

SEQ ID NO: 297 - DNA, 39 bp, Artificial Sequence
  Synthetic
ggagtgaccggctggcggctgtgcaagcgccggagcgcg

SEQ ID NO: 298 - protein, 13 aa, Artificial Sequence
  Synthetic
GVTGWRLCKRRSA

SEQ ID NO: 299 - DNA, 39 bp, Artificial Sequence
  Synthetic
ggagtgaccggctggcggctgtgcaagcgcttcagcgcg

SEQ ID NO: 300 - protein, 13 aa, Artificial Sequence
  Synthetic
GVTGWRLCKRFSA

SEQ ID NO: 301 - DNA, 39 bp, Artificial Sequence
  Synthetic
ggagtgaccggctggcggctgtgcaagcgcattagcaac

SEQ ID NO: 302 - protein, 13 aa, Artificial Sequence
  Synthetic
GVTGWRLCKRISN

SEQ ID NO: 303 - DNA, 39 bp, Artificial Sequence
  Synthetic
ggagtgaccggctggcggctgtgcaagcgcattagcacc

SEQ ID NO: 304 - protein, 13 aa, Artificial Sequence
  Synthetic
GVTGWRLCKRIST

SEQ ID NO: 305 - DNA, 39 bp, Artificial Sequence
  Synthetic
ggagtgaccggctggcggctgtgcaagcgcattagccgg

SEQ ID NO: 306 - protein, 13 aa, Artificial Sequence
  Synthetic
GVTGWRLCKRISR

SEQ ID NO: 307 - DNA, 39 bp, Artificial Sequence
  Synthetic
ggagtgaccggctggcggctgtgcaagcgcattagcctg

SEQ ID NO: 308 - protein, 13 aa, Artificial Sequence
  Synthetic
GVTGWRLCKRISL

SEQ ID NO: 309 - DNA, 39 bp, Artificial Sequence
  Synthetic
ggagtgaccggctggcggctgtgcaagcgcattagcgag

SEQ ID NO: 310 - protein, 13 aa, Artificial Sequence
  Synthetic
GVTGWRLCKRISE

SEQ ID NO: 311 - DNA, 39 bp, Artificial Sequence
  Synthetic
ggagtgaccggcttccggctgtgcaagcgcattagcgcg

SEQ ID NO: 312 - protein, 13 aa, Artificial Sequence
  Synthetic
GVTGFRLCKRISA

SEQ ID NO: 313 - DNA, 39 bp, Artificial Sequence
  Synthetic
ggagtgaccggctaccggctgtgcaagcgcattagcgcg

SEQ ID NO: 314 - protein, 13 aa, Artificial Sequence
  Synthetic
GVTGYRLCKRISA

SEQ ID NO: 315 - DNA, 39 bp, Artificial Sequence
  Synthetic
ggagtgaccggcgagcggctgtgcaagcgcattagcgcg

SEQ ID NO: 316 - protein, 13 aa, Artificial Sequence
  Synthetic
GVTGERLCKRISA

SEQ ID NO: 317 - DNA, 39 bp, Artificial Sequence
  Synthetic
caggtgaccggctggcggctgtgcaagcgcattagcgcg

SEQ ID NO: 318 - protein, 13 aa, Artificial Sequence
  Synthetic
QVTGWRLCKRISA

SEQ ID NO: 319 - DNA, 39 bp, Artificial Sequence
  Synthetic
accgtgaccggctggcggctgtgcaagcgcattagcgcg

SEQ ID NO: 320 - protein, 13 aa, Artificial Sequence
  Synthetic
TVTGWRLCKRISA

SEQ ID NO: 321 - DNA, 39 bp, Artificial Sequence
  Synthetic
ggagtggagggctggcggctgtgcaagcgcattagcgcg

SEQ ID NO: 322 - protein, 13 aa, Artificial Sequence
  Synthetic
GVEGWRLCKRISA

SEQ ID NO: 323 - DNA, 39 bp, Artificial Sequence
  Synthetic
ggagtgaccggctggcggctgttcaagcgcattagcgcg

SEQ ID NO: 324 - protein, 13 aa, Artificial Sequence
  Synthetic
GVTGWRLFKRISA

SEQ ID NO: 325 - DNA, 39 bp, Artificial Sequence
  Synthetic
ggagtgaccggctggcggctgtacaagcgcattagcgcg

SEQ ID NO: 326 - protein, 13 aa, Artificial Sequence
  Synthetic
GVTGWRLYKRISA

SEQ ID NO: 327 - DNA, 39 bp, Artificial Sequence
  Synthetic
ggagtgaccggctggcggctgagcaagcgcattagcgcg

SEQ ID NO: 328 - protein, 13 aa, Artificial Sequence
  Synthetic
GVTGWRLSKRISA

SEQ ID NO: 329 - DNA, 39 bp, Artificial Sequence
  Synthetic
ggagtgaccggctggcggctgggcaagcgcattagcgcg

SEQ ID NO: 330 - protein, 13 aa, Artificial Sequence
  Synthetic
GVTGWRLHKRISA

SEQ ID NO: 331 - DNA, 39 bp, Artificial Sequence
  Synthetic
ggagtgaccggctggcggctgatgaagcgcattagcgcg

SEQ ID NO: 332 - protein, 13 aa, Artificial Sequence
  Synthetic
GVTGWRLMKRISA

SEQ ID NO: 333 - DNA, 39 bp, Artificial Sequence
  Synthetic
ggagtgaccggctggcggctggccaagcgcattagcgcg

SEQ ID NO: 334 - protein, 13 aa, Artificial Sequence
  Synthetic
GVTGWRLAKRISA

SEQ ID NO: 335 - DNA, 39 bp, Artificial Sequence
  Synthetic
ggagtgaccggctggcggctgcagaagcgcattagcgcg

SEQ ID NO: 336 - protein, 13 aa, Artificial Sequence
  Synthetic
GVTGWRLQKRISA

SEQ ID NO: 337 - DNA, 39 bp, Artificial Sequence
  Synthetic
ggagtgaccggctggcggctgctgaagcgcattagcgcg

SEQ ID NO: 338 - protein, 13 aa, Artificial Sequence
  Synthetic
GVTGWRLLKRISA

SEQ ID NO: 339 - DNA, 39 bp, Artificial Sequence
  Synthetic
ggagtgaccggctggcggctgaagaagcgcattagcgcg

SEQ ID NO: 340 - protein, 13 aa, Artificial Sequence
  Synthetic
GVTGWRLKKRISA

SEQ ID NO: 341 - DNA, 39 bp, Artificial Sequence
  Synthetic
aaccacaccggctggcggctgaacaagaaggtgagcaac

SEQ ID NO: 342 - protein, 13 aa, Artificial Sequence
  Synthetic
NITGWRLNKKVSN

SEQ ID NO: 343 - DNA, 39 bp, Artificial Sequence
  Synthetic
aaccacaccggctaccggctgaacaagaaggtgagcaac

SEQ ID NO: 344 - protein, 13 aa, Artificial Sequence
  Synthetic
NITGYRLNKKVSN

SEQ ID NO: 345 - DNA, 39 bp, Artificial Sequence
  Synthetic
tgcgtgaccggctggcggctgttcaagcgcattagcgcg

SEQ ID NO: 346 - protein, 13 aa, Artificial Sequence
  Synthetic
CVTGWRLFKRISA

SEQ ID NO: 347 - DNA, 39 bp, Artificial Sequence
  Synthetic
cccgtgaccggctggcggctgttcaagcgcattagcgcg

SEQ ID NO: 348 - protein, 13 aa, Artificial Sequence
  Synthetic
PVTGWRLFKRISA

SEQ ID NO: 349 - DNA, 39 bp, Artificial Sequence
  Synthetic
aaccacaccggctaccggctgttcaagaaggtgagcaac

SEQ ID NO: 350 - protein, 13 aa, Artificial Sequence
  Synthetic
NITGYRLFKKVSN

SEQ ID NO: 351 - DNA, 39 bp, Artificial Sequence
  Synthetic
aacgtgaccggctaccggctgttcaagaaggtgagcaac

SEQ ID NO: 352 - protein, 13 aa, Artificial Sequence
  Synthetic
NVTGYRLFKKVSN

SEQ ID NO: 353 - DNA, 39 bp, Artificial Sequence
  Synthetic
aacgtgaccggctggcggctgttcaagaaggtgagcaac

SEQ ID NO: 354 - protein, 13 aa, Artificial Sequence
  Synthetic
NVTGWRLFKKVSN

SEQ ID NO: 355 - DNA, 39 bp, Artificial Sequence
  Synthetic
aacgtgaccggctggcggctgttcaagaagattagcaac

SEQ ID NO: 356 - protein, 13 aa, Artificial Sequence
  Synthetic
NVTGWRLFKKISN

SEQ ID NO: 357 - DNA, 39 bp, Artificial Sequence
  Synthetic
aacgtgaccggctggcggctgttcaagcgcattagcaac

SEQ ID NO: 358 - protein, 13 aa, Artificial Sequence
  Synthetic
NVTGWRLFKRISN

SEQ ID NO: 359 - DNA, 39 bp, Artificial Sequence
  Synthetic
ggagtgaccggctggcggctgttcaagcgcattagcaac

SEQ ID NO: 360 - protein, 13 aa, Artificial Sequence
  Synthetic
GVTGWRLFKRISN

SEQ ID NO: 361 - DNA, 39 bp, Artificial Sequence
  Synthetic
aacgtgaccggctggcggctgttcgaacgcattagcaac

SEQ ID NO: 362 - protein, 13 aa, Artificial Sequence
  Synthetic
NVTGWRLFERISN

SEQ ID NO: 363 - DNA, 39 bp, Artificial Sequence
  Synthetic
aacgtgaccggctggcggctgttcaagcgcattctgaac

SEQ ID NO: 364 - protein, 13 aa, Artificial Sequence
  Synthetic
NVTGWRLFKRILN

SEQ ID NO: 365 - DNA, 39 bp, Artificial Sequence
  Synthetic
aacgtgaccggctggcggctgttcaagcgcattagcgcg

SEQ ID NO: 366 - protein, 13 aa, Artificial Sequence
  Synthetic
NVTGWRLFKRISA

SEQ ID NO: 367 - DNA, 39 bp, Artificial Sequence
  Synthetic
aacgtgaccggctggcggctgttcgaaaagattagcaac

SEQ ID NO: 368 - protein, 13 aa, Artificial Sequence
  Synthetic
NVTGWRLFEKISN

SEQ ID NO: 369 - DNA, 39 bp, Artificial Sequence
  Synthetic
aacgtgagcggctggcggctgttcgaaaagattagcaac

SEQ ID NO: 370 - protein, 13 aa, Artificial Sequence
  Synthetic
NVSGWRLFEKISN

SEQ ID NO: 371 - DNA, 36 bp, Artificial Sequence
  Synthetic
gtgaccggctggcggctgttcaagaagattagcaac

SEQ ID NO: 372 - protein, 12 aa, Artificial Sequence
  Synthetic
VTGWRLFKKISN

SEQ ID NO: 373 - DNA, 39 bp, Artificial Sequence
  Synthetic
aacgtgagcggctggcggctgttcaagaagattagcaac

SEQ ID NO: 374 - protein, 13 aa, Artificial Sequence
  Synthetic
NVSGWRLFKKISN

SEQ ID NO: 375 - DNA, 39 bp, Artificial Sequence
  Synthetic
aacgtgaccggctaccggctgttcaagaagattagcaac

SEQ ID NO: 376 - protein, 13 aa, Artificial Sequence
  Synthetic
NVTGYRLFKKISN

SEQ ID NO: 377 - DNA, 36 bp, Artificial Sequence
  Synthetic
gtgagcggctggcggctgttcaagaagattagcaac

SEQ ID NO: 378 - protein, 12 aa, Artificial Sequence
  Synthetic
VSGWRLFKKISN

SEQ ID NO: 379 - DNA, 33 bp, Artificial Sequence
  Synthetic
agcggctggcggctgttcaagaagattagcaac

SEQ ID NO: 380 - protein, 11 aa, Artificial Sequence
  Synthetic
SGWRLFKKISN

SEQ ID NO: 381 - DNA, 30 bp, Artificial Sequence
  Synthetic
ggctggcggctgttcaagaagattagcaac

SEQ ID NO: 382 - protein, 10 aa, Artificial Sequence
  Synthetic
GWRLFKKISN

SEQ ID NO: 383 - DNA, 36 bp, Artificial Sequence
  Synthetic
aacgtgagcggctggcggctgttcaagaagattagc

SEQ ID NO: 384 - protein, 12 aa, Artificial Sequence
  Synthetic
NVSGWRLFKKIS

SEQ ID NO: 385 - DNA, 33 bp, Artificial Sequence
  Synthetic
aacgtgagcggctggcggctgttcaagaagatt

SEQ ID NO: 386 - protein, 11 aa, Artificial Sequence
  Synthetic
NVSGWRLFKKI

SEQ ID NO: 387 - DNA, 30 bp, Artificial Sequence
  Synthetic
aacgtgagcggctggcggctgttcaagaag

SEQ ID NO: 388 - protein, 10 aa, Artificial Sequence
  Synthetic
NVSGWRLFKK

SEQ ID NO: 389 - DNA, 33 bp, Artificial Sequence
  Synthetic
gtgagcggctggcggctgttcaagaagattagc

SEQ ID NO: 390 - protein, 11 aa, Artificial Sequence
  Synthetic
VSGWRLFKKIS

SEQ ID NO: 391 - DNA, 27 bp, Artificial Sequence
  Synthetic
agcggctggcggctgttcaagaagatt

SEQ ID NO: 392 - protein, 9 aa, Artificial Sequence
  Synthetic
SGWRLFKKI

SEQ ID NO: 393 - DNA, 39 bp, Artificial Sequence
  Synthetic
aacgtgagcggctggggcctgttcaagaagattagcaac

SEQ ID NO: 394 - protein, 13 aa, Artificial Sequence
  Synthetic
NVSGWGLFKKISN

SEQ ID NO: 395 - DNA, 39 bp, Artificial Sequence
  Synthetic
cccgtgagcggctggcggctgttcaagaagattagcaac

SEQ ID NO: 396 - protein, 13 aa, Artificial Sequence
  Synthetic
PVSGWRLFKKISN

SEQ ID NO: 397 - DNA, 42 bp, Artificial Sequence
  Synthetic
aaccccgtgagcggctggcggctgttcaagaagattagcaac

SEQ ID NO: 398 - protein, 14 aa, Artificial Sequence
  Synthetic
NPVSGWRLFKKISN

SEQ ID NO: 399 - DNA, 45 bp, Artificial Sequence
  Synthetic
atcaaccccgtgagcggctggcggctgttcaagaagattagcaac

SEQ ID NO: 400 - protein, 15 aa, Artificial Sequence
  Synthetic
INPVSGWRLFKKISN

SEQ ID NO: 401 - DNA, 48 bp, Artificial Sequence
  Synthetic
accatcaaccccgtgagcggctggcggctgttcaagaagattagcaac

SEQ ID NO: 402 - protein, 16 aa, Artificial Sequence
  Synthetic
TINPVSGWRLFKKISN

SEQ ID NO: 403 - DNA, 51 bp, Artificial Sequence
  Synthetic
gtgaccatcaaccccgtgagcggctggcggctgttcaagaagattagcaac

SEQ ID NO: 404 - protein, 17 aa, Artificial Sequence
  Synthetic
VTINPVSGWRLFKKISN

SEQ ID NO: 405 - DNA, 54 bp, Artificial Sequence
  Synthetic
cgggtgaccatcaaccccgtgagcggctggcggctgttcaagaagattagcaac

SEQ ID NO: 406 - protein, 18 aa, Artificial Sequence
  Synthetic
RVTINPVSGWRLFKKISN

SEQ ID NO: 407 - DNA, 27 bp, Artificial Sequence
  Synthetic
agcggctggcggctgctgaagaagatt

SEQ ID NO: 408 - protein, 9 aa, Artificial Sequence
  Synthetic
SGWRLLKKI

SEQ ID NO: 409 - DNA, 27 bp, Artificial Sequence
  Synthetic
accggctaccggctgctgaagaagatt

SEQ ID NO: 410 - protein, 9 aa, Artificial Sequence
  Synthetic
TGYRLLKKI

SEQ ID NO: 411 - DNA, 24 bp, Artificial Sequence
  Synthetic
agcggctggcggctgttcaagaag

SEQ ID NO: 412 - protein, 8 aa, Artificial Sequence
  Synthetic
SGWRLFKK

SEQ ID NO: 413 - DNA, 33 bp, Artificial Sequence
  Synthetic
gtgaccggctaccggctgttcaagaagattagc

SEQ ID NO: 414 - protein, 11 aa, Artificial Sequence
  Synthetic
VTGYRLFKKIS

SEQ ID NO: 415 - DNA, 33 bp, Artificial Sequence
  Synthetic
gtgaccggctaccggctgttcgagaagattagc

SEQ ID NO: 416 - protein, 11 aa, Artificial Sequence
  Synthetic
VTGYRLFEKIS

SEQ ID NO: 417 - DNA, 33 bp, Artificial Sequence
  Synthetic
gtgaccggctaccggctgttcgagcagattagc

SEQ ID NO: 418 - protein, 11 aa, Artificial Sequence
  Synthetic
VTGYRLFEQIS

SEQ ID NO: 419 - DNA, 33 bp, Artificial Sequence
  Synthetic
gtgaccggctaccggctgttcgagaaggagagc

SEQ ID NO: 420 - protein, 11 aa, Artificial Sequence
  Synthetic
VTGYRLFEKES

SEQ ID NO: 421 - DNA, 33 bp, Artificial Sequence
  Synthetic
gtgaccggctaccggctgttcgagcaggagagc

SEQ ID NO: 422 - protein, 11 aa, Artificial Sequence
  Synthetic
VTGYRLFEQES

SEQ ID NO: 423 - DNA, 33 bp, Artificial Sequence
  Synthetic
gtgaccggctaccggctgttcgagcaggagctg

SEQ ID NO: 424 - protein, 11 aa, Artificial Sequence
  Synthetic
VTGYRLFEQEL

SEQ ID NO: 425 - DNA, 33 bp, Artificial Sequence
  Synthetic
gtggagggctaccggctgttcgagaagattagc

SEQ ID NO: 426 - protein, 11 aa, Artificial Sequence
  Synthetic
VEGYRLFEKIS

SEQ ID NO: 427 - DNA, 33 bp, Artificial Sequence
  Synthetic
gtggagggctaccggctgttcgagcagattagc

SEQ ID NO: 428 - protein, 11 aa, Artificial Sequence
  Synthetic
VEGYRLFEQIS

SEQ ID NO: 429 - DNA, 33 bp, Artificial Sequence
  Synthetic
gtggagggctaccggctgttcgagaaggagagc

SEQ ID NO: 430 - protein, 11 aa, Artificial Sequence
  Synthetic
VEGYRLFEKES

SEQ ID NO: 431 - DNA, 33 bp, Artificial Sequence
  Synthetic
gtggagggctaccggctgttcgagcaggagagc

SEQ ID NO: 432 - protein, 11 aa, Artificial Sequence
  Synthetic
VEGYRLFEQES

SEQ ID NO: 433 - DNA, 33 bp, Artificial Sequence
  Synthetic
gtggagggctaccggctgttcgagcaggagctg

SEQ ID NO: 434 - protein, 11 aa, Artificial Sequence
  Synthetic
VEGYRLFEQEL

SEQ ID NO: 435 - DNA, 33 bp, Artificial Sequence
  Synthetic
attagcggctggcggctgatgaagaacattagc

SEQ ID NO: 436 - protein, 11 aa, Artificial Sequence
  Synthetic
ISGWRLMKNIS

SEQ ID NO: 437 - DNA, 33 bp, Artificial Sequence
  Synthetic
gtggagggctaccggctgttcaagaagattagc

SEQ ID NO: 438 - protein, 11 aa, Artificial Sequence
  Synthetic
VEGYRLFKKIS

SEQ ID NO: 439 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 440 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 441 - DNA, 477 bp, Artificial Sequence
  Synthetic
atggtcttcacactcgaagatttcgttggggactggcaacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 442 - protein, 159 aa, Artificial Sequence
  Synthetic
MVFTLEDFVGDWNQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 443 - DNA, 477 bp, Artificial Sequence
  Synthetic
atggtcttcacactcgaagatttcgttggggactggcgacagatcgccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 444 - protein, 159 aa, Artificial Sequence
  Synthetic
MVFTLEDFVGDWRQIAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 445 - DNA, 477 bp, Artificial Sequence
  Synthetic
atggtcttcacactcgaagatttcgttggggactggcgacagacagccagctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 446 - protein, 159 aa, Artificial Sequence
  Synthetic
MVFTLEDFVGDWRQTASYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 447 - DNA, 477 bp, Artificial Sequence
  Synthetic
atggtcttcacactcgaagatttcgttggggactggcgacagacagccggctacaaccaggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 448 - protein, 159 aa, Artificial Sequence
  Synthetic
MVFTLEDFVGDWRQTAGYNQDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 449 - DNA, 477 bp, Artificial Sequence
  Synthetic
atggtcttcacactcgaagatttcgttggggactggcgacagacagccggctacaacctggacaaggtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 450 - protein, 159 aa, Artificial Sequence
  Synthetic
MVFTLEDFVGDWRQTAGYNLDKVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 451 - DNA, 477 bp, Artificial Sequence
  Synthetic
atggtcttcacactcgaagatttcgttggggactggcgacagacagccggctacaacctggaccaagtccttgaacagggaggtatgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 452 - protein, 159 aa, Artificial Sequence
  Synthetic
MVFTLEDFVGDWRQTAGYNLDQVLEQGGMSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 453 - DNA, 477 bp, Artificial Sequence
  Synthetic
atggtcttcacactcgaagatttcgttggggactggcgacagacagccggctacaacctggaccaagtccttgaacagggaggtgtgtccagtttgatacagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 454 - protein, 159 aa, Artificial Sequence
  Synthetic
MVFTLEDFVGDWRQTAGYNLDQVLEQGGVSSLIQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 455 - DNA, 477 bp, Artificial Sequence
  Synthetic
atggtcttcacactcgaagatttcgttggggactggcgacagacagccggctacaacctggaccaagtccttgaacagggaggtgtgtccagtttgttgcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 456 - protein, 159 aa, Artificial Sequence
  Synthetic
MVFTLEDFVGDWRQTAGYNLDQVLEQGGVSSLLQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 457 - DNA, 477 bp, Artificial Sequence
  Synthetic
atggtcttcacactcgaagatttcgttggggactggcgacagacagccggctacaacctggaccaagtccttgaacagggaggtgtgtccagtttggttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 458 - protein, 159 aa, Artificial Sequence
  Synthetic
MVFTLEDFVGDWRQTAGYNLDQVLEQGGVSSLVQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 459 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcggaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 460 - protein, 159 aa, Artificial Sequence
  Synthetic
MVFTLEDFVGDWRQTAGYNLDQVLEQGGVSSLFRNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 461 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaaactcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 462 - protein, 159 aa, Artificial Sequence
  Synthetic
MVFTLEDFVGDWRQTAGYNLDQVLEQGGVSSLFQKLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 463 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagcggctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 464 - protein, 159 aa, Artificial Sequence
  Synthetic
MVFTLEDFVGDWRQTAGYNLDQVLEQGGVSSLFQRLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 465 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacaaccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 466 - protein, 159 aa, Artificial Sequence
  Synthetic
MVFTLEDFVGDWRQTAGYNLDQVLEQGGVSSLFQNLGVSVTPIQRIVLSGENGLKIDNHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 467 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgccatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 468 - protein, 159 aa, Artificial Sequence
  Synthetic
MVFTLEDFVGDWRQTAGYNLDQVLEQGGVSSLFQNLGVSVTPIQRIVLSGENGLKIDIHAIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 469 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcaccatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 470 - protein, 159 aa, Artificial Sequence
  Synthetic
MVFTLEDFVGDWRQTAGYNLDQVLEQGGVSSLFQNLGVSVTPIQRIVLSGENGLKIDIHVTIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 471 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcagcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 472 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSSDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 473 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgacgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 474 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSDDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 475 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 476 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 477 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 478 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 479 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacattatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 480 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 481 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 482 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 483 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacagccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 484 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGQPYEGIAVFDGKKITVTGTLWNGNKIIDERLINPDGSLLFRVTINV

SEQ ID NO: 485 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 486 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 487 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 488 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 489 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcgacgtt

SEQ ID NO: 490 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIDV

SEQ ID NO: 491 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcagcgtt

SEQ ID NO: 492 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTISV

SEQ ID NO: 493 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgat

SEQ ID NO: 494 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 495 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 496 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 497 - DNA, 477 bp, Artificial Sequence
  Synthetic
atggtcttcacactcgaagatttcgttgccgactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 498 - protein, 159 aa, Artificial Sequence
  Synthetic
MVFTLEDFVADWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 499 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 500 - protein, 159 aa, Artificial Sequence
  Synthetic
MVFTLEDFVGDWRQTAAYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 501 - DNA, 477 bp, Artificial Sequence
  Synthetic
atggtcttcacactcgaagatttcgttggggactggcgacagacagccggctacaacctggaccaagtccttgaacaggccggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 502 - protein, 159 aa, Artificial Sequence
  Synthetic
MVFTLEDFVGDWRQTAGYNLDQVLEQAGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 503 - DNA, 477 bp, Artificial Sequence
  Synthetic
atggtcttcacactcgaagatttcgttggggactggcgacagacagccggctacaacctggaccaagtccttgaacagggagccgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 504 - protein, 159 aa, Artificial Sequence
  Synthetic
MVFTLEDFVGDWRQTAGYNLDQVLEQGAVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 505 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 506 - protein, 159 aa, Artificial Sequence
  Synthetic
MVFTLEDFVGDWRQTAGYNLDQVLEQGGVSSLFQNLAVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 507 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcgccgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 508 - protein, 159 aa, Artificial Sequence
  Synthetic
MVFTLEDFVGDWRQTAGYNLDQVLEQGGVSSLFQNLGVSVTPIQRIVLSAENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 509 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 510 - protein, 159 aa, Artificial Sequence
  Synthetic
MVFTLEDFVGDWRQTAGYNLDQVLEQGGVSSLFQNLGVSVTPIQRIVLSGENALKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 511 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaagccctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 512 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEALSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 513 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 514 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 515 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 516 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 517 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatgccacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 518 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYATLVIDGVTPNMIDYFGRPYEGIAVFDGKKITVTGTLWNGNKIIDERLINPDGSLLFRVTINV

SEQ ID NO: 519 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacgccgttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 520 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDAVTPNMIDYFGRPYEGIAVFDGKKITVTGTLWNGNKIIDERLINPDGSLLFRVTINV

SEQ ID NO: 521 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcgcccggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 522 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFARPYEGIAVFDGKKITVTGTLWNGNKIIDERLINPDGSLLFRVTINV

SEQ ID NO: 523 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaagccatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 524 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEAIAVFDGKKITVTGTLWNGNKIIDERLINPDGSLLFRVTINV

SEQ ID NO: 525 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacgccaaaaagatcactgtaacagggaccctgtggaacggcaacaaaattatcgacgagcgcctgatcaaccccgacggctccctgctgttccgagtaaccatcaacgtt

SEQ ID NO: 526 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDAKKITVTGTLWNGNKIIDERLINPDGSLLFRVTINV

SEQ ID NO: 527 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagccaccctgtggaacggcaacaaaattatcgacgagcgcctgatcaaccccgacggctccctgctgttccgagtaaccatcaacgtt

SEQ ID NO: 528 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTATLWNGNKIIDERLINPDGSLLFRVTINV

SEQ ID NO: 529 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacgccaacaaaattatcgacgagcgcctgatcaaccccgacggctccctgctgttccgagtaaccatcaacgtt

SEQ ID NO: 530 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNANKIIDERLINPDGSLLFRVTINV

SEQ ID NO: 531 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacgcctccctgctgttccgagtaaccatcaacgtt

SEQ ID NO: 532 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDASLLFRVTINV

SEQ ID NO: 533 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaaggccgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 534 - protein, 159 aa, Artificial Sequence
  Synthetic
MVFTLEDFVGDWRQTAGYNLDQVLEQGGVSSLFQNLGVSVTPIQRIVLSGENGLKADIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 535 - DNA, 477 bp, Artificial Sequence
  Synthetic
atggtcttcacactcgaagatttcgttggggactggcgacagacagccgcctacaacctggcccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 536 - protein, 159 aa, Artificial Sequence
  Synthetic
MVFTLEDFVGDWRQTAAYNLAQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 537 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 538 - protein, 159 aa, Artificial Sequence
  Synthetic
MVFTLEDFVGDWRQTAAYNLDQVLEQGGVSSLFQNLAVSVTPIQRIVLSGENGLKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 539 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 540 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 541 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 542 - protein, 159 aa, Artificial Sequence
  Synthetic
MVFTLEDFVGDWRQTAGYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 543 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 544 - protein, 159 aa, Artificial Sequence
  Synthetic
MVFTLEDFVGDWRQTAAYNLDQVLEQGGVSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 545 - DNA, 477 bp, Artificial Sequence; identical to SEQ ID NO: 537
  Synthetic

SEQ ID NO: 546 - protein, 159 aa, Artificial Sequence; identical to SEQ ID NO: 538
  Synthetic

SEQ ID NO: 547 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 548 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 549 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 550 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 551 - DNA, 477 bp, Artificial Sequence
  Synthetic
atggtcttcacactcgaagatttcgttggggactgggcccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 552 - protein, 159 aa, Artificial Sequence
  Synthetic
MVFTLEDFVGDWAQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 553 - DNA, 477 bp, Artificial Sequence
  Synthetic
atggtcttcacactcgaagatttcgttggggactggtgccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 554 - protein, 159 aa, Artificial Sequence
  Synthetic
MVFTLEDFVGDWCQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 555 - DNA, 477 bp, Artificial Sequence
  Synthetic
atggtcttcacactcgaagatttcgttggggactgggaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 556 - protein, 159 aa, Artificial Sequence
  Synthetic
MVFTLEDFVGDWDQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 557 - DNA, 477 bp, Artificial Sequence
  Synthetic
atggtcttcacactcgaagatttcgttggggactgggagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 558 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 559 - DNA, 477 bp, Artificial Sequence
  Synthetic
atggtcttcacactcgaagatttcgttggggactggttccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 560 - protein, 159 aa, Artificial Sequence
  Synthetic
MVFTLEDFVGDWFQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 561 - DNA, 477 bp, Artificial Sequence
  Synthetic
atggtcttcacactcgaagatttcgttggggactggggccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 562 - protein, 159 aa, Artificial Sequence
  Synthetic
MVFTLEDFVGDWGQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 563 - DNA, 477 bp, Artificial Sequence
  Synthetic
atggtcttcacactcgaagatttcgttggggactggcaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 564 - protein, 159 aa, Artificial Sequence
  Synthetic
MVFTLEDFVGDWHQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 565 - DNA, 477 bp, Artificial Sequence
  Synthetic
atggtcttcacactcgaagatttcgttggggactggatccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 566 - protein, 159 aa, Artificial Sequence
  Synthetic
MVFTLEDFVGDWIQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 567 - DNA, 477 bp, Artificial Sequence
  Synthetic
atggtcttcacactcgaagatttcgttggggactggaagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 568 - protein, 159 aa, Artificial Sequence
  Synthetic
MVFTLEDFVGDWKQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 569 - DNA, 477 bp, Artificial Sequence
  Synthetic
atggtcttcacactcgaagatttcgttggggactggctgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 570 - protein, 159 aa, Artificial Sequence
  Synthetic
MVFTLEDFVGDWLQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 571 - DNA, 477 bp, Artificial Sequence
  Synthetic
atggtcttcacactcgaagatttcgttggggactggatgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 572 - protein, 159 aa, Artificial Sequence
  Synthetic
MVFTLEDFVGDWMQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 573 - DNA, 477 bp, Artificial Sequence
  Synthetic
atggtcttcacactcgaagatttcgttggggactggaaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 574 - protein, 159 aa, Artificial Sequence
  Synthetic
MVFTLEDFVGDWNQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 575 - DNA, 477 bp, Artificial Sequence
  Synthetic
atggtcttcacactcgaagatttcgttggggactggccccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 576 - protein, 159 aa, Artificial Sequence
  Synthetic
MVFTLEDFVGDWPQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 577 - DNA, 477 bp, Artificial Sequence
  Synthetic
atggtcttcacactcgaagatttcgttggggactggcagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 578 - protein, 159 aa, Artificial Sequence
  Synthetic
MVFTLEDFVGDWQQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 579 - DNA, 477 bp, Artificial Sequence
  Synthetic
atggtcttcacactcgaagatttcgttggggactggagccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 580 - protein, 159 aa, Artificial Sequence
  Synthetic
MVFTLEDFVGDWSQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 581 - DNA, 477 bp, Artificial Sequence
  Synthetic
atggtcttcacactcgaagatttcgttggggactggacccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 582 - protein, 159 aa, Artificial Sequence
  Synthetic
MVFTLEDFVGDWTQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 583 - DNA, 477 bp, Artificial Sequence
  Synthetic
atggtcttcacactcgaagatttcgttggggactgggtgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 584 - protein, 159 aa, Artificial Sequence
  Synthetic
MVFTLEDFVGDWVQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 585 - DNA, 477 bp, Artificial Sequence
  Synthetic
atggtcttcacactcgaagatttcgttggggactggtggcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 586 - protein, 159 aa, Artificial Sequence
  Synthetic
MVFTLEDFVGDWWQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 587 - DNA, 477 bp, Artificial Sequence
  Synthetic
atggtcttcacactcgaagatttcgttggggactggtaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 588 - protein, 159 aa, Artificial Sequence
  Synthetic
MVFTLEDFVGDWYQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 589 - DNA, 477 bp, Artificial Sequence
  Synthetic
atggtcttcacactcgaagatttcgttggggactggcgacagacagcctgctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 590 - protein, 159 aa, Artificial Sequence
  Synthetic
MVFTLEDFVGDWRQTACYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 591 - DNA, 477 bp, Artificial Sequence
  Synthetic
atggtcttcacactcgaagatttcgttggggactggcgacagacagccgactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 592 - protein, 159 aa, Artificial Sequence
  Synthetic
MVFTLEDFVGDWRQTADYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 593 - DNA, 477 bp, Artificial Sequence
  Synthetic
atggtcttcacactcgaagatttcgttggggactggcgacagacagccgagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 594 - protein, 159 aa, Artificial Sequence
  Synthetic
MVFTLEDFVGDWRQTAEYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 595 - DNA, 477 bp, Artificial Sequence
  Synthetic
atggtcttcacactcgaagatttcgttggggactggcgacagacagccttctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 596 - protein, 159 aa, Artificial Sequence
  Synthetic
MVFTLEDFVGDWRQTAFYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 597 - DNA, 477 bp, Artificial Sequence; identical to SEQ ID NO: 541
  Synthetic

SEQ ID NO: 598 - protein, 159 aa, Artificial Sequence; identical to SEQ ID NO: 542
  Synthetic

SEQ ID NO: 599 - DNA, 477 bp, Artificial Sequence
  Synthetic
atggtcttcacactcgaagatttcgttggggactggcgacagacagcccactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 600 - protein, 159 aa, Artificial Sequence
  Synthetic
MVFTLEDFVGDWRQTAHYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 601 - DNA, 477 bp, Artificial Sequence
  Synthetic
atggtcttcacactcgaagatttcgttggggactggcgacagacagccatctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 602 - protein, 159 aa, Artificial Sequence
  Synthetic
MVFTLEDFVGDWRQTAIYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 603 - DNA, 477 bp, Artificial Sequence
  Synthetic
atggtcttcacactcgaagatttcgttggggactggcgacagacagccaagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 604 - protein, 159 aa, Artificial Sequence
  Synthetic
MVFTLEDFVGDWRQTAKYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 605 - DNA, 477 bp, Artificial Sequence
  Synthetic
atggtcttcacactcgaagatttcgttggggactggcgacagacagccctgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 606 - protein, 159 aa, Artificial Sequence
  Synthetic
MVFTLEDFVGDWRQTALYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 607 - DNA, 477 bp, Artificial Sequence
  Synthetic
atggtcttcacactcgaagatttcgttggggactggcgacagacagccatgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 608 - protein, 159 aa, Artificial Sequence
  Synthetic
MVFTLEDFVGDWRQTAMYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 609 - DNA, 477 bp, Artificial Sequence
  Synthetic
atggtcttcacactcgaagatttcgttggggactggcgacagacagccaactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 610 - protein, 159 aa, Artificial Sequence
  Synthetic
MVFTLEDFVGDWRQTANYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 611 - DNA, 477 bp, Artificial Sequence
  Synthetic
atggtcttcacactcgaagatttcgttggggactggcgacagacagccccctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 612 - protein, 159 aa, Artificial Sequence
  Synthetic
MVFTLEDFVGDWRQTAPYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 613 - DNA, 477 bp, Artificial Sequence
  Synthetic
atggtcttcacactcgaagatttcgttggggactggcgacagacagcccagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 614 - protein, 159 aa, Artificial Sequence
  Synthetic
MVFTLEDFVGDWRQTAQYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 615 - DNA, 477 bp, Artificial Sequence
  Synthetic
atggtcttcacactcgaagatttcgttggggactggcgacagacagcccggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 616 - protein, 159 aa, Artificial Sequence
  Synthetic
MVFTLEDFVGDWRQTARYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 617 - DNA, 477 bp, Artificial Sequence
  Synthetic
atggtcttcacactcgaagatttcgttggggactggcgacagacagccagctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 618 - protein, 159 aa, Artificial Sequence
  Synthetic
MVFTLEDFVGDWRQTASYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 619 - DNA, 477 bp, Artificial Sequence
  Synthetic
atggtcttcacactcgaagatttcgttggggactggcgacagacagccacctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 620 - protein, 159 aa, Artificial Sequence
  Synthetic
MVFTLEDFVGDWRQTATYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 621 - DNA, 477 bp, Artificial Sequence
  Synthetic
atggtcttcacactcgaagatttcgttggggactggcgacagacagccgtgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 622 - protein, 159 aa, Artificial Sequence
  Synthetic
MVFTLEDFVGDWRQTAVYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 623 - DNA, 477 bp, Artificial Sequence
  Synthetic
atggtcttcacactcgaagatttcgttggggactggcgacagacagcctggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 624 - protein, 159 aa, Artificial Sequence
  Synthetic
MVFTLEDFVGDWRQTAWYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 625 - DNA, 477 bp, Artificial Sequence
  Synthetic
atggtcttcacactcgaagatttcgttggggactggcgacagacagcctactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 626 - protein, 159 aa, Artificial Sequence
  Synthetic
MVFTLEDFVGDWRQTAYYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 627 - DNA, 477 bp, Artificial Sequence
  Synthetic
atggtcttcacactcgaagatttcgttggggactggcgacagacagccgcctacaacgccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 628 - protein, 159 aa, Artificial Sequence
  Synthetic
MVFTLEDFVGDWRQTAAYNADQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 629 - DNA, 477 bp, Artificial Sequence
  Synthetic
atggtcttcacactcgaagatttcgttggggactggcgacagacagccgcctacaactgcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 630 - protein, 159 aa, Artificial Sequence
  Synthetic
MVFTLEDFVGDWRQTAAYNCDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 631 - DNA, 477 bp, Artificial Sequence
  Synthetic
atggtcttcacactcgaagatttcgttggggactggcgacagacagccgcctacaacgacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 632 - protein, 159 aa, Artificial Sequence
  Synthetic
MVFTLEDFVGDWRQTAAYNDDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 633 - DNA, 477 bp, Artificial Sequence
  Synthetic
atggtcttcacactcgaagatttcgttggggactggcgacagacagccgcctacaacgaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 634 - protein, 159 aa, Artificial Sequence
  Synthetic
MVFTLEDFVGDWRQTAAYNEDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 635 - DNA, 477 bp, Artificial Sequence
  Synthetic
atggtcttcacactcgaagatttcgttggggactggcgacagacagccgcctacaacttcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 636 - protein, 159 aa, Artificial Sequence
  Synthetic
MVFTLEDFVGDWRQTAAYNFDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 637 - DNA, 477 bp, Artificial Sequence
  Synthetic
atggtcttcacactcgaagatttcgttggggactggcgacagacagccgcctacaacggcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 638 - protein, 159 aa, Artificial Sequence
  Synthetic
MVFTLEDFVGDWRQTAAYNGDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 639 - DNA, 477 bp, Artificial Sequence
  Synthetic
atggtcttcacactcgaagatttcgttggggactggcgacagacagccgcctacaaccacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 640 - protein, 159 aa, Artificial Sequence
  Synthetic
MVFTLEDFVGDWRQTAAYNHDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 641 - DNA, 477 bp, Artificial Sequence
  Synthetic
atggtcttcacactcgaagatttcgttggggactggcgacagacagccgcctacaacatcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 642 - protein, 159 aa, Artificial Sequence
  Synthetic
MVFTLEDFVGDWRQTAAYNIDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 643 - DNA, 477 bp, Artificial Sequence
  Synthetic
atggtcttcacactcgaagatttcgttggggactggcgacagacagccgcctacaacaaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 644 - protein, 159 aa, Artificial Sequence
  Synthetic
MVFTLEDFVGDWRQTAAYNKDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 645 - DNA, 477 bp, Artificial Sequence
  Synthetic
atggtcttcacactcgaagatttcgttggggactggcgacagacagccgcctacaacatggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 646 - protein, 159 aa, Artificial Sequence
  Synthetic
MVFTLEDFVGDWRQTAAYNMDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 647 - DNA, 477 bp, Artificial Sequence
  Synthetic
atggtcttcacactcgaagatttcgttggggactggcgacagacagccgcctacaacaacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 648 - protein, 159 aa, Artificial Sequence
  Synthetic
MVFTLEDFVGDWRQTAAYNNDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 649 - DNA, 477 bp, Artificial Sequence
  Synthetic
atggtcttcacactcgaagatttcgttggggactggcgacagacagccgcctacaaccccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 650 - protein, 159 aa, Artificial Sequence
  Synthetic
MVFTLEDFVGDWRQTAAYNPDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 651 - DNA, 477 bp, Artificial Sequence
  Synthetic
atggtcttcacactcgaagatttcgttggggactggcgacagacagccgcctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 652 - protein, 159 aa, Artificial Sequence
  Synthetic
MVFTLEDFVGDWRQTAAYNQDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 653 - DNA, 477 bp, Artificial Sequence
  Synthetic
atggtcttcacactcgaagatttcgttggggactggcgacagacagccgcctacaaccgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 654 - protein, 159 aa, Artificial Sequence
  Synthetic
MVFTLEDFVGDWRQTAAYNRDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 655 - DNA, 477 bp, Artificial Sequence
  Synthetic
atggtcttcacactcgaagatttcgttggggactggcgacagacagccgcctacaacagcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 656 - protein, 159 aa, Artificial Sequence
  Synthetic
MVFTLEDFVGDWRQTAAYNSDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 657 - DNA, 477 bp, Artificial Sequence
  Synthetic
atggtcttcacactcgaagatttcgttggggactggcgacagacagccgcctacaacaccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 658 - protein, 159 aa, Artificial Sequence
  Synthetic
MVFTLEDFVGDWRQTAAYNTDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 659 - DNA, 477 bp, Artificial Sequence
  Synthetic
atggtcttcacactcgaagatttcgttggggactggcgacagacagccgcctacaacgtggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 660 - protein, 159 aa, Artificial Sequence
  Synthetic
MVFTLEDFVGDWRQTAAYNVDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 661 - DNA, 477 bp, Artificial Sequence
  Synthetic
atggtcttcacactcgaagatttcgttggggactggcgacagacagccgcctacaactgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 662 - protein, 159 aa, Artificial Sequence
  Synthetic
MVFTLEDFVGDWRQTAAYNWDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 663 - DNA, 477 bp, Artificial Sequence
  Synthetic
atggtcttcacactcgaagatttcgttggggactggcgacagacagccgcctacaactacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 664 - protein, 159 aa, Artificial Sequence
  Synthetic
MVFTLEDFVGDWRQTAAYNYDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 665 - DNA, 477 bp, Artificial Sequence
  Synthetic
atggtcttcacactcgaagatttcgttggggactggcgacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 666 - protein, 159 aa, Artificial Sequence
  Synthetic
MVFTLEDFVGDWRQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 667 - DNA, 477 bp, Artificial Sequence
  Synthetic
atggtcttcacactcgaagatttcgttggggactggcgacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 668 - protein, 159 aa, Artificial Sequence
  Synthetic
MVFTLEDFVGDWRQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 669 - DNA, 477 bp, Artificial Sequence
  Synthetic
atggtcttcacactcgaagatttcgttggggactggcgacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 670 - protein, 159 aa, Artificial Sequence
  Synthetic
MVFTLEDFVGDWRQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 671 - DNA, 477 bp, Artificial Sequence
  Synthetic
atggtcttcacactcgaagatttcgttggggactggcgacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 672 - protein, 159 aa, Artificial Sequence
  Synthetic
MVFTLEDFVGDWRQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 673 - DNA, 477 bp, Artificial Sequence
  Synthetic
atggtcttcacactcgaagatttcgttggggactggcgacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 674 - protein, 159 aa, Artificial Sequence
  Synthetic
MVFTLEDFVGDWRQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 675 - DNA, 477 bp, Artificial Sequence
  Synthetic
atggtcttcacactcgaagatttcgttggggactggcgacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 676 - protein, 159 aa, Artificial Sequence
  Synthetic
MVFTLEDFVGDWRQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 677 - DNA, 477 bp, Artificial Sequence
  Synthetic
atggtcttcacactcgaagatttcgttggggactggcgacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 678 - protein, 159 aa, Artificial Sequence
  Synthetic
MVFTLEDFVGDWRQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 679 - DNA, 477 bp, Artificial Sequence
  Synthetic
atggtcttcacactcgaagatttcgttggggactggcgacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 680 - protein, 159 aa, Artificial Sequence
  Synthetic
MVFTLEDFVGDWRQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 681 - DNA, 477 bp, Artificial Sequence
  Synthetic
atggtcttcacactcgaagatttcgttggggactggcgacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 682 - protein, 159 aa, Artificial Sequence
  Synthetic
MVFTLEDFVGDWRQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 683 - DNA, 477 bp, Artificial Sequence
  Synthetic
atggtcttcacactcgaagatttcgttggggactggcgacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 684 - protein, 159 aa, Artificial Sequence
  Synthetic
MVFTLEDFVGDWRQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 685 - DNA, 477 bp, Artificial Sequence
  Synthetic
atggtcttcacactcgaagatttcgttggggactggcgacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 686 - protein, 159 aa, Artificial Sequence
  Synthetic
MVFTLEDFVGDWRQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 687 - DNA, 477 bp, Artificial Sequence
  Synthetic
atggtcttcacactcgaagatttcgttggggactggcgacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 688 - protein, 159 aa, Artificial Sequence
  Synthetic
MVFTLEDFVGDWRQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 689 - DNA, 477 bp, Artificial Sequence
  Synthetic
atggtcttcacactcgaagatttcgttggggactggcgacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 690 - protein, 159 aa, Artificial Sequence
  Synthetic
MVFTLEDFVGDWRQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 691 - DNA, 477 bp, Artificial Sequence
  Synthetic
atggtcttcacactcgaagatttcgttggggactggcgacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 692 - protein, 159 aa, Artificial Sequence
  Synthetic
MVFTLEDFVGDWRQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 693 - DNA, 477 bp, Artificial Sequence
  Synthetic
atggtcttcacactcgaagatttcgttggggactggcgacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 694 - protein, 159 aa, Artificial Sequence
  Synthetic
MVFTLEDFVGDWRQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 695 - DNA, 477 bp, Artificial Sequence
  Synthetic
atggtcttcacactcgaagatttcgttggggactggcgacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 696 - protein, 159 aa, Artificial Sequence
  Synthetic
MVFTLEDFVGDWRQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 697 - DNA, 477 bp, Artificial Sequence
  Synthetic
atggtcttcacactcgaagatttcgttggggactggcgacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 698 - protein, 159 aa, Artificial Sequence
  Synthetic
MVFTLEDFVGDWRQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 699 - DNA, 477 bp, Artificial Sequence
  Synthetic
atggtcttcacactcgaagatttcgttggggactggcgacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 700 - protein, 159 aa, Artificial Sequence
  Synthetic
MVFTLEDFVGDWRQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 701 - DNA, 477 bp, Artificial Sequence
  Synthetic
atggtcttcacactcgaagatttcgttggggactggcgacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 702 - protein, 159 aa, Artificial Sequence
  Synthetic
MVFTLEDFVGDWRQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 703 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 704 - protein, 159 aa, Artificial Sequence
  Synthetic
MVFTLEDFVGDWRQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 705 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattgcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 706 - protein, 159 aa, Artificial Sequence
  Synthetic
MVFTLEDFVGDWRQTAAYNLDQVLEQGGVSSLFQNLAVSVTPIQRIVLSGENALKIDIHCIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 707 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 708 - protein, 159 aa, Artificial Sequence
  Synthetic
MVFTLEDFVGDWRQTAAYNLDQVLEQGGVSSLFQNLAVSVTPIQRIVLSGENALKIDIHDIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 709 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 710 - protein, 159 aa, Artificial Sequence
  Synthetic
MVFTLEDFVGDWRQTAAYNLDQVLEQGGVSSLFQNLAVSVTPIQRIVLSGENALKIDIHEIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 711 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatttcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 712 - protein, 159 aa, Artificial Sequence
  Synthetic
MVFTLEDFVGDWRQTAAYNLDQVLEQGGVSSLFQNLAVSVTPIQRIVLSGENALKIDIHFIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 713 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatggcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 714 - protein, 159 aa, Artificial Sequence
  Synthetic
MVFTLEDFVGDWRQTAAYNLDQVLEQGGVSSLFQNLAVSVTPIQRIVLSGENALKIDIHGIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 715 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 716 - protein, 159 aa, Artificial Sequence
  Synthetic
MVFTLEDFVGDWRQTAAYNLDQVLEQGGVSSLFQNLAVSVTPIQRIVLSGENALKIDIHHIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 717 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 718 - protein, 159 aa, Artificial Sequence
  Synthetic
MVFTLEDFVGDWRQTAAYNLDQVLEQGGVSSLFQNLAVSVTPIQRIVLSGENALKIDIHIIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 719 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 720 - protein, 159 aa, Artificial Sequence
  Synthetic
MVFTLEDFVGDWRQTAAYNLDQVLEQGGVSSLFQNLAVSVTPIQRIVLSGENALKIDIHKIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 721 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatctgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 722 - protein, 159 aa, Artificial Sequence
  Synthetic
MVFTLEDFVGDWRQTAAYNLDQVLEQGGVSSLFQNLAVSVTPIQRIVLSGENALKIDIHLIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 723 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 724 - protein, 159 aa, Artificial Sequence
  Synthetic
MVFTLEDFVGDWRQTAAYNLDQVLEQGGVSSLFQNLAVSVTPIQRIVLSGENALKIDIHMIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 725 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 726 - protein, 159 aa, Artificial Sequence
  Synthetic
MVFTLEDFVGDWRQTAAYNLDQVLEQGGVSSLFQNLAVSVTPIQRIVLSGENALKIDIHNIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 727 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 728 - protein, 159 aa, Artificial Sequence
  Synthetic
MVFTLEDFVGDWRQTAAYNLDQVLEQGGVSSLFQNLAVSVTPIQRIVLSGENALKIDIHPIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 729 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 730 - protein, 159 aa, Artificial Sequence
  Synthetic
MVFTLEDFVGDWRQTAAYNLDQVLEQGGVSSLFQNLAVSVTPIQRIVLSGENALKIDIHQIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 731 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 732 - protein, 159 aa, Artificial Sequence
  Synthetic
MVFTLEDFVGDWRQTAAYNLDQVLEQGGVSSLFQNLAVSVTPIQRIVLSGENALKIDIHRIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 733 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatagcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 734 - protein, 159 aa, Artificial Sequence
  Synthetic
MVFTLEDFVGDWRQTAAYNLDQVLEQGGVSSLFQNLAVSVTPIQRIVLSGENALKIDIHSIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 735 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 736 - protein, 159 aa, Artificial Sequence
  Synthetic
MVFTLEDFVGDWRQTAAYNLDQVLEQGGVSSLFQNLAVSVTPIQRIVLSGENALKIDIHTIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 737 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 738 - protein, 159 aa, Artificial Sequence
  Synthetic
MVFTLEDFVGDWRQTAAYNLDQVLEQGGVSSLFQNLAVSVTPIQRIVLSGENALKIDIHWIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 739 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 740 - protein, 159 aa, Artificial Sequence
  Synthetic
MVFTLEDFVGDWRQTAAYNLDQVLEQGGVSSLFQNLAVSVTPIQRIVLSGENALKIDIHYIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 741 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 742 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSCDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 743 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 744 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSDDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 745 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 746 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSEDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 747 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcttcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 748 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSFDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 749 - DNA, 477 bp, Artificial Sequence; identical to SEQ ID NO: 547
  Synthetic

SEQ ID NO: 750 - protein, 159 aa, Artificial Sequence; identical to SEQ ID NO: 548
  Synthetic

SEQ ID NO: 751 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 752 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSHDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 753 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 754 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSIDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 755 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 756 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSKDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 757 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcctggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 758 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSLDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 759 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 760 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSMDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 761 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 762 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSNDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 763 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 764 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSPDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 765 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 766 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSQDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 767 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 768 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSRDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 769 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcagcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 770 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSSDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 771 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 772 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSTDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 773 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgtggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 774 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSVDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 775 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 776 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSWDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 777 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 778 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSYDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 779 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 780 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNAIDYFGRPYEGIAVFDGKKITVTGTLWNGNKIIDERLINPDGSLLFRVTINV

SEQ ID NO: 781 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactgcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 782 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNCIDYFGRPYEGIAVFDGKKITVTGTLWNGNKIIDERLINPDGSLLFRVTINV

SEQ ID NO: 783 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 784 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNDIDYFGRPYEGIAVFDGKKITVTGTLWNGNKIIDERLINPDGSLLFRVTINV

SEQ ID NO: 785 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 786 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNEIDYFGRPYEGIAVFDGKKITVTGTLWNGNKIIDERLINPDGSLLFRVTINV

SEQ ID NO: 787 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacttcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 788 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNFIDYFGRPYEGIAVFDGKKITVTGTLWNGNKIIDERLINPDGSLLFRVTINV

SEQ ID NO: 789 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacggcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 790 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNGIDYFGRPYEGIAVFDGKKITVTGTLWNGNKIIDERLINPDGSLLFRVTINV

SEQ ID NO: 791 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 792 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNHIDYFGRPYEGIAVFDGKKITVTGTLWNGNKIIDERLINPDGSLLFRVTINV

SEQ ID NO: 793 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 794 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 795 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 796 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNKIDYFGRPYEGIAVFDGKKITVTGTLWNGNKIIDERLINPDGSLLFRVTINV

SEQ ID NO: 797 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacctgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 798 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNLIDYFGRPYEGIAVFDGKKITVTGTLWNGNKIIDERLINPDGSLLFRVTINV

SEQ ID NO: 799 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 800 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNNIDYFGRPYEGIAVFDGKKITVTGTLWNGNKIIDERLINPDGSLLFRVTINV

SEQ ID NO: 801 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 802 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNPIDYFGRPYEGIAVFDGKKITVTGTLWNGNKIIDERLINPDGSLLFRVTINV

SEQ ID NO: 803 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 804 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNQIDYFGRPYEGIAVFDGKKITVTGTLWNGNKIIDERLINPDGSLLFRVTINV

SEQ ID NO: 805 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 806 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNRIDYFGRPYEGIAVFDGKKITVTGTLWNGNKIIDERLINPDGSLLFRVTINV

SEQ ID NO: 807 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacagcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 808 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNSIDYFGRPYEGIAVFDGKKITVTGTLWNGNKIIDERLINPDGSLLFRVTINV

SEQ ID NO: 809 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 810 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNTIDYFGRPYEGIAVFDGKKITVTGTLWNGNKIIDERLINPDGSLLFRVTINV

SEQ ID NO: 811 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 812 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 813 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 814 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNWIDYFGRPYEGIAVFDGKKITVTGTLWNGNKIIDERLINPDGSLLFRVTINV

SEQ ID NO: 815 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 816 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNYIDYFGRPYEGIAVFDGKKITVTGTLWNGNKIIDERLINPDGSLLFRVTINV

SEQ ID NO: 817 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgccctgttccgagtaaccatcaacgtt

SEQ ID NO: 818 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSALFRVTINV

SEQ ID NO: 819 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctgcctgttccgagtaaccatcaacgtt

SEQ ID NO: 820 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSCLFRVTINV

SEQ ID NO: 821 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgacctgttccgagtaaccatcaacgtt

SEQ ID NO: 822 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSDLFRVTINV

SEQ ID NO: 823 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgagctgttccgagtaaccatcaacgtt

SEQ ID NO: 824 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSELFRVTINV

SEQ ID NO: 825 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccttcctgttccgagtaaccatcaacgtt

SEQ ID NO: 826 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSFLFRVTINV

SEQ ID NO: 827 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccggcctgttccgagtaaccatcaacgtt

SEQ ID NO: 828 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSGLFRVTINV

SEQ ID NO: 829 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccacctgttccgagtaaccatcaacgtt

SEQ ID NO: 830 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSHLFRVTINV

SEQ ID NO: 831 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatcctgttccgagtaaccatcaacgtt

SEQ ID NO: 832 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSILFRVTINV

SEQ ID NO: 833 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaagctgttccgagtaaccatcaacgtt

SEQ ID NO: 834 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSKLFRVTINV

SEQ ID NO: 835 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 836 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 837 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaacctgttccgagtaaccatcaacgtt

SEQ ID NO: 838 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSNLFRVTINV

SEQ ID NO: 839 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccccctgttccgagtaaccatcaacgtt

SEQ ID NO: 840 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSPLFRVTINV

SEQ ID NO: 841 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccagctgttccgagtaaccatcaacgtt

SEQ ID NO: 842 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSQLFRVTINV

SEQ ID NO: 843 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccggctgttccgagtaaccatcaacgtt

SEQ ID NO: 844 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSRLFRVTINV

SEQ ID NO: 845 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccagcctgttccgagtaaccatcaacgtt

SEQ ID NO: 846 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSSLFRVTINV

SEQ ID NO: 847 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaccctgttccgagtaaccatcaacgtt

SEQ ID NO: 848 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSTLFRVTINV

SEQ ID NO: 849 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgtgctgttccgagtaaccatcaacgtt

SEQ ID NO: 850 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSVLFRVTINV

SEQ ID NO: 851 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctggctgttccgagtaaccatcaacgtt

SEQ ID NO: 852 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSWLFRVTINV

SEQ ID NO: 853 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctacctgttccgagtaaccatcaacgtt

SEQ ID NO: 854 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSYLFRVTINV

SEQ ID NO: 855 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgcc

SEQ ID NO: 856 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINA

SEQ ID NO: 857 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgc

SEQ ID NO: 858 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINC

SEQ ID NO: 859 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 860 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 861 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgag

SEQ ID NO: 862 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINE

SEQ ID NO: 863 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacttc

SEQ ID NO: 864 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINF

SEQ ID NO: 865 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggc

SEQ ID NO: 866 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTING

SEQ ID NO: 867 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccac

SEQ ID NO: 868 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINH

SEQ ID NO: 869 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatc

SEQ ID NO: 870 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINI

SEQ ID NO: 871 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaag

SEQ ID NO: 872 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINK

SEQ ID NO: 873 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacctg

SEQ ID NO: 874 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINL

SEQ ID NO: 875 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatg

SEQ ID NO: 876 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINM

SEQ ID NO: 877 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaac

SEQ ID NO: 878 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINN

SEQ ID NO: 879 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 880 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 881 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccag

SEQ ID NO: 882 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINQ

SEQ ID NO: 883 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccgg

SEQ ID NO: 884 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINR

SEQ ID NO: 885 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 886 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 887 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacacc

SEQ ID NO: 888 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINT

SEQ ID NO: 889 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgg

SEQ ID NO: 890 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINW

SEQ ID NO: 891 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactac

SEQ ID NO: 892 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINY

SEQ ID NO: 893 - DNA, 477 bp, Artificial Sequence
  Synthetic
atggtcttcacactcgaagatttcgttggggactggcgacagacagccgcctacaacctggacaaggtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 894 - protein, 159 aa, Artificial Sequence
  Synthetic
MVFTLEDFVGDWRQTAAYNLDKVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 895 - DNA, 477 bp, Artificial Sequence
  Synthetic
atggtcttcacactcgaagatttcgttggggactggcgacagacagccgcctacaacctggaccaagtccttgaacagggaggtatgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 896 - protein, 159 aa, Artificial Sequence
  Synthetic
MVFTLEDFVGDWRQTAAYNLDQVLEQGGMSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 897 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaagctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 898 - protein, 159 aa, Artificial Sequence
  Synthetic
MVFTLEDFVGDWRQTAAYNLDQVLEQGGVSSLFQKLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 899 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccatcactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 900 - protein, 159 aa, Artificial Sequence
  Synthetic
MVFTLEDFVGDWRQTAAYNLDQVLEQGGVSSLFQNLAVSITPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 901 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 902 - protein, 159 aa, Artificial Sequence
  Synthetic
MVFTLEDFVGDWRQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 903 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 904 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 905 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 906 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 907 - DNA, 477 bp, Artificial Sequence
  Synthetic
atggtcttcacactcgaagatttcgttggggactggcgacagacagccgcctacaacctggaccaagtccttgaacagggaggtatgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 908 - protein, 159 aa, Artificial Sequence
  Synthetic
MVFTLEDFVGDWRQTAAYNLDQVLEQGGMSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 909 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 910 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 911 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 912 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 913 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 914 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 915 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 916 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSLLFRVTINV

SEQ ID NO: 917 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 918 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 919 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 920 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 921 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 922 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 923 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 924 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINP

SEQ ID NO: 925 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 926 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINP

SEQ ID NO: 927 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 928 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINE

SEQ ID NO: 929 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 930 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINE

SEQ ID NO: 931 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 932 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINE

SEQ ID NO: 933 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 934 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 935 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 936 - protein, 159 aa, Artificial Sequence
  Synthetic
MVFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 937 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 938 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 939 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 940 - protein, 159 aa, Artificial Sequence
  Synthetic
MVFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 941 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 942 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 943 - DNA, 477 bp, Artificial Sequence
  Synthetic
atggtcttcacactcgaagatttcgttggggactggcgacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 944 - protein, 159 aa, Artificial Sequence
  Synthetic
MVFTLEDFVGDWRQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 945 - DNA, 477 bp, Artificial Sequence
  Synthetic
atggtcttcacactcgaagatttcgttggggactggcaacagacagccgcctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 946 - protein, 159 aa, Artificial Sequence
  Synthetic
MVFTLEDFVGDWNQTAAYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 947 - DNA, 477 bp, Artificial Sequence
  Synthetic
atggtcttcacactcgaagatttcgttggggactggcaacagacagccagctacaacctggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 948 - protein, 159 aa, Artificial Sequence
  Synthetic
MVFTLEDFVGDWNQTASYNLDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 949 - DNA, 477 bp, Artificial Sequence
  Synthetic
atggtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 950 - protein, 159 aa, Artificial Sequence
  Synthetic
MVFTLEDFVGDWNQTASYNQDQVLEQGGVSSLFQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 951 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 952 - protein, 159 aa, Artificial Sequence
  Synthetic
MVFTLEDFVGDWNQTASYNQDQVLEQGGVSSLIQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 953 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 954 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 955 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 956 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 957 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 958 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSLLFRVTIND

SEQ ID NO: 959 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 960 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTINV

SEQ ID NO: 961 - DNA, 477 bp, Artificial Sequence
  Synthetic
atggtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 962 - protein, 159 aa, Artificial Sequence
  Synthetic
MVFTLEDFVGDWRQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 963 - DNA, 477 bp, Artificial Sequence
  Synthetic
atggtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 964 - protein, 159 aa, Artificial Sequence
  Synthetic
MVFTLEDFVGDWRQTASYNQDQVLEQGGVSSLFQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 965 - DNA, 477 bp, Artificial Sequence
  Synthetic
atggtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 966 - protein, 159 aa, Artificial Sequence
  Synthetic
MVFTLEDFVGDWNQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 967 - DNA, 480 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtg

SEQ ID NO: 968 - protein, 160 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPV

SEQ ID NO: 969 - DNA, 480 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgcc

SEQ ID NO: 970 - protein, 160 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPA

SEQ ID NO: 971 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgacc

SEQ ID NO: 972 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVT

SEQ ID NO: 973 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtggcc

SEQ ID NO: 974 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVA

SEQ ID NO: 975 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccacc

SEQ ID NO: 976 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAT

SEQ ID NO: 977 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccgcc

SEQ ID NO: 978 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAA

SEQ ID NO: 979 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcggc

SEQ ID NO: 980 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGG

SEQ ID NO: 981 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcacc

SEQ ID NO: 982 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGT

SEQ ID NO: 983 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccaccggc

SEQ ID NO: 984 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPATG

SEQ ID NO: 985 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggc

SEQ ID NO: 986 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTG

SEQ ID NO: 987 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccgcc

SEQ ID NO: 988 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTA

SEQ ID NO: 989 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcaccgcc

SEQ ID NO: 990 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGTA

SEQ ID NO: 991 - DNA, 489 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgg

SEQ ID NO: 992 - protein, 163 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGW

SEQ ID NO: 993 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcgg

SEQ ID NO: 994 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWR

SEQ ID NO: 995 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgggag

SEQ ID NO: 996 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWE

SEQ ID NO: 997 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggaag

SEQ ID NO: 998 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWK

SEQ ID NO: 999 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcag

SEQ ID NO: 1000 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWQ

SEQ ID NO: 1001 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcac

SEQ ID NO: 1002 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWH

SEQ ID NO: 1003 - DNA, 474 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaac

SEQ ID NO: 1004 - protein, 158 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIN

SEQ ID NO: 1005 - DNA, 471 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatc

SEQ ID NO: 1006 - protein, 157 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTI

SEQ ID NO: 1007 - DNA, 468 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaacc

SEQ ID NO: 1008 - protein, 156 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVT

SEQ ID NO: 1009 - DNA, 465 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagta

SEQ ID NO: 1010 - protein, 155 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRV

SEQ ID NO: 1011 - DNA, 462 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccga

SEQ ID NO: 1012 - protein, 154 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFR

SEQ ID NO: 1013 - DNA, 459 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttc

SEQ ID NO: 1014 - protein, 153 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLF

SEQ ID NO: 1015 - DNA, 456 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctg

SEQ ID NO: 1016 - protein, 152 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSML

SEQ ID NO: 1017 - DNA, 477 bp, Artificial Sequence
  Synthetic
atggtcttcacactcgaagatttcgttggggactgggaacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1018 - protein, 159 aa, Artificial Sequence
  Synthetic
MVFTLEDFVGDWEQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1019 - DNA, 477 bp, Artificial Sequence
  Synthetic
atggtcttcacactcgaagatttcgttggggactgggaacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1020 - protein, 159 aa, Artificial Sequence
  Synthetic
MVFTLEDFVGDWEQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1021 - DNA, 477 bp, Artificial Sequence
  Synthetic
atggtcttcacactcgaagatttcgttggggactgggaacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1022 - protein, 159 aa, Artificial Sequence
  Synthetic
MVFTLEDFVGDWEQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1023 - DNA, 477 bp, Artificial Sequence
  Synthetic
atggtcttcacactcgaagatttcgttggggactgggaacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1024 - protein, 159 aa, Artificial Sequence
  Synthetic
MVFTLEDFVGDWEQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1025 - DNA, 477 bp, Artificial Sequence
  Synthetic
atggtcttcacactcgaagatttcgttggggactgggaacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1026 - protein, 159 aa, Artificial Sequence
  Synthetic
MVFTLEDFVGDWEQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1027 - DNA, 477 bp, Artificial Sequence
  Synthetic
atggtcttcacactcgaagatttcgttggggactgggaacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1028 - protein, 159 aa, Artificial Sequence
  Synthetic
MVFTLEDFVGDWEQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1029 - DNA, 477 bp, Artificial Sequence
  Synthetic
atggtcttcacactcgaagatttcgttggggactgggaacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1030 - protein, 159 aa, Artificial Sequence
  Synthetic
MVFTLEDFVGDWEQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1031 - DNA, 477 bp, Artificial Sequence
  Synthetic
atggtcttcacactcgaagatttcgttggggactgggaacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1032 - protein, 159 aa, Artificial Sequence
  Synthetic
MVFTLEDFVGDWEQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1033 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1034 - protein, 159 aa, Artificial Sequence
  Synthetic
MVFTLEDFVGDWEQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1035 - DNA, 477 bp, Artificial Sequence
  Synthetic
atggtcttcacactcgaagatttcgttggggactgggaacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1036 - protein, 159 aa, Artificial Sequence
  Synthetic
MVFTLEDFVGDWEQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1037 - DNA, 477 bp, Artificial Sequence
  Synthetic
atggtcttcacactcgaagatttcgttggggactgggaacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1038 - protein, 159 aa, Artificial Sequence
  Synthetic
MVFTLEDFVGDWEQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1039 - DNA, 477 bp, Artificial Sequence
  Synthetic
atggtcttcacactcgaagatttcgttggggactgggaacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1040 - protein, 159 aa, Artificial Sequence
  Synthetic
MVFTLEDFVGDWEQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1041 - DNA, 477 bp, Artificial Sequence
  Synthetic
atggtcttcacactcgaagatttcgttggggactgggaacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1042 - protein, 159 aa, Artificial Sequence
  Synthetic
MVFTLEDFVGDWEQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1043 - DNA, 477 bp, Artificial Sequence
  Synthetic
atggtcttcacactcgaagatttcgttggggactgggaacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1044 - protein, 159 aa, Artificial Sequence
  Synthetic
MVFTLEDFVGDWEQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1045 - DNA, 477 bp, Artificial Sequence
  Synthetic
atggtcttcacactcgaagatttcgttggggactgggaacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1046 - protein, 159 aa, Artificial Sequence
  Synthetic
MVFTLEDFVGDWEQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1047 - DNA, 477 bp, Artificial Sequence
  Synthetic
atggtcttcacactcgaagatttcgttggggactgggaacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1048 - protein, 159 aa, Artificial Sequence
  Synthetic
MVFTLEDFVGDWEQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1049 - DNA, 477 bp, Artificial Sequence
  Synthetic
atggtcttcacactcgaagatttcgttggggactgggaacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1050 - protein, 159 aa, Artificial Sequence
  Synthetic
MVFTLEDFVGDWEQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1051 - DNA, 477 bp, Artificial Sequence
  Synthetic
atggtcttcacactcgaagatttcgttggggactgggaacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1052 - protein, 159 aa, Artificial Sequence
  Synthetic
MVFTLEDFVGDWEQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1053 - DNA, 477 bp, Artificial Sequence
  Synthetic
atggtcttcacactcgaagatttcgttggggactgggaacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1054 - protein, 159 aa, Artificial Sequence
  Synthetic
MVFTLEDFVGDWEQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1055 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1056 - protein, 159 aa, Artificial Sequence
  Synthetic
MVFTLEDFVGDWEQTAAYNLDQVLEQGGVSSLFQNLAVSVTPIQRIVASGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1057 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtctgcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1058 - protein, 159 aa, Artificial Sequence
  Synthetic
MVFTLEDFVGDWEQTAAYNLDQVLEQGGVSSLFQNLAVSVTPIQRIVCSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1059 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1060 - protein, 159 aa, Artificial Sequence
  Synthetic
MVFTLEDFVGDWEQTAAYNLDQVLEQGGVSSLFQNLAVSVTPIQRIVDSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1061 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1062 - protein, 159 aa, Artificial Sequence
  Synthetic
MVFTLEDFVGDWEQTAAYNLDQVLEQGGVSSLFQNLAVSVTPIQRIVESGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1063 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcttcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1064 - protein, 159 aa, Artificial Sequence
  Synthetic
MVFTLEDFVGDWEQTAAYNLDQVLEQGGVSSLFQNLAVSVTPIQRIVFSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1065 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcggcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1066 - protein, 159 aa, Artificial Sequence
  Synthetic
MVFTLEDFVGDWEQTAAYNLDQVLEQGGVSSLFQNLAVSVTPIQRIVGSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1067 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1068 - protein, 159 aa, Artificial Sequence
  Synthetic
MVFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1069 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1070 - protein, 159 aa, Artificial Sequence
  Synthetic
MVFTLEDFVGDWEQTAAYNLDQVLEQGGVSSLFQNLAVSVTPIQRIVISGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1071 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1072 - protein, 159 aa, Artificial Sequence
  Synthetic
MVFTLEDFVGDWEQTAAYNLDQVLEQGGVSSLFQNLAVSVTPIQRIVKSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1073 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1074 - protein, 159 aa, Artificial Sequence
  Synthetic
MVFTLEDFVGDWEQTAAYNLDQVLEQGGVSSLFQNLAVSVTPIQRIVMSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1075 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1076 - protein, 159 aa, Artificial Sequence
  Synthetic
MVFTLEDFVGDWEQTAAYNLDQVLEQGGVSSLFQNLAVSVTPIQRIVNSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1077 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1078 - protein, 159 aa, Artificial Sequence
  Synthetic
MVFTLEDFVGDWEQTAAYNLDQVLEQGGVSSLFQNLAVSVTPIQRIVPSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1079 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1080 - protein, 159 aa, Artificial Sequence
  Synthetic
MVFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1081 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1082 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1083 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcagcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1084 - protein, 159 aa, Artificial Sequence
  Synthetic
MVFTLEDFVGDWEQTAAYNLDQVLEQGGVSSLFQNLAVSVTPIQRIVSSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1085 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1086 - protein, 159 aa, Artificial Sequence
  Synthetic
MVFTLEDFVGDWEQTAAYNLDQVLEQGGVSSLFQNLAVSVTPIQRIVTSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1087 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgtgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1088 - protein, 159 aa, Artificial Sequence
  Synthetic
MVFTLEDFVGDWEQTAAYNLDQVLEQGGVSSLFQNLAVSVTPIQRIVVSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1089 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtctggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1090 - protein, 159 aa, Artificial Sequence
  Synthetic
MVFTLEDFVGDWEQTAAYNLDQVLEQGGVSSLFQNLAVSVTPIQRIVWSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1091 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtctacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1092 - protein, 159 aa, Artificial Sequence
  Synthetic
MVFTLEDFVGDWEQTAAYNLDQVLEQGGVSSLFQNLAVSVTPIQRIVYSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1093 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgcctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1094 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIAYFGRPYEGIAVFDGKKITVTGTLWNGNKIIDERLITPDGSMLFRVTINP

SEQ ID NO: 1095 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctgctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1096 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMICYFGRPYEGIAVFDGKKITVTGTLWNGNKIIDERLITPDGSMLFRVTINP

SEQ ID NO: 1097 - DNA, 477 bp, Artificial Sequence; identical to SEQ ID NO: 925
  Synthetic

SEQ ID NO: 1098 - protein, 159 aa, Artificial Sequence; identical to SEQ ID NO: 926
  Synthetic

SEQ ID NO: 1099 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1100 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIEYFGRPYEGIAVFDGKKITVTGTLWNGNKIIDERLITPDGSMLFRVTINP

SEQ ID NO: 1101 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcttctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1102 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIFYFGRPYEGIAVFDGKKITVTGTLWNGNKIIDERLITPDGSMLFRVTINP

SEQ ID NO: 1103 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcggctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1104 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIGYFGRPYEGIAVFDGKKITVTGTLWNGNKIIDERLITPDGSMLFRVTINP

SEQ ID NO: 1105 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1106 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIHYFGRPYEGIAVFDGKKITVTGTLWNGNKIIDERLITPDGSMLFRVTINP

SEQ ID NO: 1107 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1108 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIIYFGRPYEGIAVFDGKKITVTGTLWNGNKIIDERLITPDGSMLFRVTINP

SEQ ID NO: 1109 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1110 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIKYFGRPYEGIAVFDGKKITVTGTLWNGNKIIDERLITPDGSMLFRVTINP

SEQ ID NO: 1111 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcctgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1112 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMILYFGRPYEGIAVFDGKKITVTGTLWNGNKIIDERLITPDGSMLFRVTINP

SEQ ID NO: 1113 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1114 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIMYFGRPYEGIAVFDGKKITVTGTLWNGNKIIDERLITPDGSMLFRVTINP

SEQ ID NO: 1115 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcccctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1116 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIPYFGRPYEGIAVFDGKKITVTGTLWNGNKIIDERLITPDGSMLFRVTINP

SEQ ID NO: 1117 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1118 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIQYFGRPYEGIAVFDGKKITVTGTLWNGNKIIDERLITPDGSMLFRVTINP

SEQ ID NO: 1119 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1120 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIRYFGRPYEGIAVFDGKKITVTGTLWNGNKIIDERLITPDGSMLFRVTINP

SEQ ID NO: 1121 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcagctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1122 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMISYFGRPYEGIAVFDGKKITVTGTLWNGNKIIDERLITPDGSMLFRVTINP

SEQ ID NO: 1123 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcacctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1124 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMITYFGRPYEGIAVFDGKKITVTGTLWNGNKIIDERLITPDGSMLFRVTINP

SEQ ID NO: 1125 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgtgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1126 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIVYFGRPYEGIAVFDGKKITVTGTLWNGNKIIDERLITPDGSMLFRVTINP

SEQ ID NO: 1127 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1128 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIWYFGRPYEGIAVFDGKKITVTGTLWNGNKIIDERLITPDGSMLFRVTINP

SEQ ID NO: 1129 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1130 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIYYFGRPYEGIAVFDGKKITVTGTLWNGNKIIDERLITPDGSMLFRVTINP

SEQ ID NO: 1131 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgcccccgacggctccatgctgttccgagtaaccatcaacccc

SEQ ID NO: 1132 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIAPDGSMLFRVTINP

SEQ ID NO: 1133 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctgccccgacggctccatgctgttccgagtaaccatcaacccc

SEQ ID NO: 1134 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLICPDGSMLFRVTINP

SEQ ID NO: 1135 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgaccccgacggctccatgctgttccgagtaaccatcaacccc

SEQ ID NO: 1136 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIDPDGSMLFRVTINP

SEQ ID NO: 1137 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgagcccgacggctccatgctgttccgagtaaccatcaacccc

SEQ ID NO: 1138 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIEPDGSMLFRVTINP

SEQ ID NO: 1139 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcttccccgacggctccatgctgttccgagtaaccatcaacccc

SEQ ID NO: 1140 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIFPDGSMLFRVTINP

SEQ ID NO: 1141 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcggccccgacggctccatgctgttccgagtaaccatcaacccc

SEQ ID NO: 1142 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIGPDGSMLFRVTINP

SEQ ID NO: 1143 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccaccccgacggctccatgctgttccgagtaaccatcaacccc

SEQ ID NO: 1144 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIHPDGSMLFRVTINP

SEQ ID NO: 1145 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatccccgacggctccatgctgttccgagtaaccatcaacccc

SEQ ID NO: 1146 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIIPDGSMLFRVTINP

SEQ ID NO: 1147 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaagcccgacggctccatgctgttccgagtaaccatcaacccc

SEQ ID NO: 1148 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIKPDGSMLFRVTINP

SEQ ID NO: 1149 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcctgcccgacggctccatgctgttccgagtaaccatcaacccc

SEQ ID NO: 1150 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLILPDGSMLFRVTINP

SEQ ID NO: 1151 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatgcccgacggctccatgctgttccgagtaaccatcaacccc

SEQ ID NO: 1152 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIMPDGSMLFRVTINP

SEQ ID NO: 1153 - DNA, 477 bp, Artificial Sequence; identical to SEQ ID NO: 923
  Synthetic

SEQ ID NO: 1154 - protein, 159 aa, Artificial Sequence; identical to SEQ ID NO: 924
  Synthetic

SEQ ID NO: 1155 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcccccccgacggctccatgctgttccgagtaaccatcaacccc

SEQ ID NO: 1156 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIPPDGSMLFRVTINP

SEQ ID NO: 1157 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccagcccgacggctccatgctgttccgagtaaccatcaacccc

SEQ ID NO: 1158 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIQPDGSMLFRVTINP

SEQ ID NO: 1159 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccggcccgacggctccatgctgttccgagtaaccatcaacccc

SEQ ID NO: 1160 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIRPDGSMLFRVTINP

SEQ ID NO: 1161 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcagccccgacggctccatgctgttccgagtaaccatcaacccc

SEQ ID NO: 1162 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLISPDGSMLFRVTINP

SEQ ID NO: 1163 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgtgcccgacggctccatgctgttccgagtaaccatcaacccc

SEQ ID NO: 1164 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIVPDGSMLFRVTINP

SEQ ID NO: 1165 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctggcccgacggctccatgctgttccgagtaaccatcaacccc

SEQ ID NO: 1166 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIWPDGSMLFRVTINP

SEQ ID NO: 1167 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctaccccgacggctccatgctgttccgagtaaccatcaacccc

SEQ ID NO: 1168 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIYPDGSMLFRVTINP

SEQ ID NO: 1169 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgcc

SEQ ID NO: 1170 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINA

SEQ ID NO: 1171 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgc

SEQ ID NO: 1172 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINC

SEQ ID NO: 1173 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgac

SEQ ID NO: 1174 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIND

SEQ ID NO: 1175 - DNA, 477 bp, Artificial Sequence; identical to SEQ ID NO: 937
  Synthetic

SEQ ID NO: 1176 - protein, 159 aa, Artificial Sequence; identical to SEQ ID NO: 938
  Synthetic

SEQ ID NO: 1177 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacttc

SEQ ID NO: 1178 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINF

SEQ ID NO: 1179 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggc

SEQ ID NO: 1180 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTING

SEQ ID NO: 1181 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 1182 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 1183 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatc

SEQ ID NO: 1184 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINI

SEQ ID NO: 1185 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaag

SEQ ID NO: 1186 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINK

SEQ ID NO: 1187 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacctg

SEQ ID NO: 1188 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINL

SEQ ID NO: 1189 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatg

SEQ ID NO: 1190 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINM

SEQ ID NO: 1191 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaac

SEQ ID NO: 1192 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINN

SEQ ID NO: 1193 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccag

SEQ ID NO: 1194 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINQ

SEQ ID NO: 1195 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccgg

SEQ ID NO: 1196 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINR

SEQ ID NO: 1197 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1198 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 1199 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacacc

SEQ ID NO: 1200 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINT

SEQ ID NO: 1201 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgtg

SEQ ID NO: 1202 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINV

SEQ ID NO: 1203 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgg

SEQ ID NO: 1204 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINW

SEQ ID NO: 1205 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactac

SEQ ID NO: 1206 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINY

SEQ ID NO: 1207 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1208 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMLNYFGRPYEGIAVFDGKKITVTGTLWNGNKIIDERLITPDGSMLFRVTINP

SEQ ID NO: 1209 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1210 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEEIFKVVYPVDDHHFKVILHYGTLVIDGVTPNMINYFGRPYEGIAVFDGKKITVTGTLWNGNKIIDERLITPDGSMLFRVTINP

SEQ ID NO: 1211 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcgacccc

SEQ ID NO: 1212 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTIDP

SEQ ID NO: 1213 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1214 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKVFKVVYPVDDHHFKVILHYGTLVIDGVTPNMINYFGRPYEGIAVFDGKKITVTGTLWNGNKIIDERLITPDGSMLFRVTINP

SEQ ID NO: 1215 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcatgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1216 - protein, 159 aa, Artificial Sequence
  Synthetic
MVFTLEDFVGDWEQTAAYNLDQVLEQGGVSSLFQNLAVSVTPIQRIVLSDENALKIDIRVIIPYEGLSADQMAQIEKIFKVVYPVDDHHFKVIMHYGTLVVDGVTPNMINYFGRPYEGIAVFDGKKITVTGTLWNGNKIIDERLITPDGSMLFRVTINP

SEQ ID NO: 1217 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1218 - protein, 159 aa, Artificial Sequence
  Synthetic
MVFTLEDFVGDWEQTAAYNLDQVLEQGGVSSLLQNLAASVTPIQRIVLSGENALKIDIHVIIPYEGLSADQMAQIEKIFKVVYPVDDHHFKVILHYGTLVVDGVTPNMINYFGRPYEGIAVFDGKKITVTGTLWNGNKIIDERLITPDGSMLFRVTINP

SEQ ID NO: 1219 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1220 - protein, 159 aa, Artificial Sequence
  Synthetic
MVFTLEDFVGDWEQTAAYNLDQVLEQGGVSSLLQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1221 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggccatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1222 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKAILHYGTLVIDGVTPNMINYFGRPYEGIAVFDGKKITVTGTLWNGNKIIDERLITPDGSMLFRVTINP

SEQ ID NO: 1223 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaagggtggtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1224 - protein, 159 aa, Artificial Sequence
  Synthetic
MVFTLEDFVGDWEQTAAYNLDQVLEQGGVSSLFQNLAVSVTPIQRVVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1225 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacgtgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1226 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDQHFKVILHYGTLVIDGVTPNVINYFGRPYEGIAVFDGKKITVTGTLWNGNKIIDERLITPDGSMLFRVTINP

SEQ ID NO: 1227 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcacctgatcacccccgacggctccatgctgttccgagtaaccatcaacccc

SEQ ID NO: 1228 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDEHLITPDGSMLFRVTINP

SEQ ID NO: 1229 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcaggacctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1230 - protein, 159 aa, Artificial Sequence
  Synthetic
MVFTLEDFVGDWEQTAAYNLDQVLEQGGVSSLFQDLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1231 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggccacaaaattatcgacgagcgcctgatcacccccgacggctccatgctgttccgagtaaccatcaacccc

SEQ ID NO: 1232 - protein, 159 aa, Artificial Sequence
  Synthetic
MVFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGHKIIDERLITPDGSMLFRVTINP

SEQ ID NO: 1233 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 1234 - protein, 159 aa, Artificial Sequence
  Synthetic
MVFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 1235 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcgtgccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1236 - protein, 159 aa, Artificial Sequence
  Synthetic
MVFTLEDFVGDWEQTAAYNLDQVLEQGGVSSLFQNLAVSVTPIQRIVLSGENALKIDIHVIVPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1237 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcaaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1238 - protein, 159 aa, Artificial Sequence
  Synthetic
MVFTLEDFVGDWEQTAAYNLDQVLEQGGVSSLFQNLAVSVTPIQRIVLSGENTLKIDIHVIIPYEGLSADQMAQIKKIFKVVYPVDDHHFKVILHYGTLVIDGVTPNMINYFGRLYEGIAVFDGKKITVTGTLWNGNKIIDERLITPDGSMLFRVTINP

SEQ ID NO: 1239 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1240 - protein, 159 aa, Artificial Sequence
  Synthetic
MVFTLEDFVGDWEQTAAYNLDQVLEQGGVSSLFQNLAASVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1241 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1242 - protein, 159 aa, Artificial Sequence
  Synthetic
MVFTLEDFVGDWEQTAAYNLDQVLEQGGVSSLFQNLAVSVTPIQRIVLSGENTLKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1243 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1244 - protein, 159 aa, Artificial Sequence
  Synthetic
MVFTLEDFVGDWEQTAAYNLDQVLEQGGVSSLFQNLAVSVTPIQRIVLSGENALKIDIRVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1245 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1246 - protein, 159 aa, Artificial Sequence
  Synthetic
MVFTLEDFVGDWEQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1247 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcaagaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1248 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIKKIFKVVYPVDDHHFKVILHYGTLVIDGVTPNMINYFGRPYEGIAVFDGKKITVTGTLWNGNKIIDERLITPDGSMLFRVTINP

SEQ ID NO: 1249 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1250 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDQHFKVILHYGTLVIDGVTPNMINYFGRPYEGIAVFDGKKITVTGTLWNGNKIIDERLITPDGSMLFRVTINP

SEQ ID NO: 1251 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1252 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1253 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcaacccc

SEQ ID NO: 1254 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTINP

SEQ ID NO: 1255 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaagcgggaccctgtggaacggcaacaaaattatcgacgagcgcctgatcacccccgacggctccatgctgttccgagtaaccatcaacccc

SEQ ID NO: 1256 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVSGTLWNGNKIIDERLITPDGSMLFRVTINP

SEQ ID NO: 1257 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgccagatcacccccgacggctccatgctgttccgagtaaacatcaacccc

SEQ ID NO: 1258 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERQITPDGSMLFRVNINP

SEQ ID NO: 1259 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcgacccc

SEQ ID NO: 1260 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIDP

SEQ ID NO: 1261 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccaggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1262 - protein, 159 aa, Artificial Sequence
  Synthetic
MVFTLEDFVGDWEQTAAYNLDQVLEQGGVSSLFQNLAVSVTPIQRIVLSGENALKIDIQVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1263 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcatgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1264 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVIMHYGTLVIDGVTPNMINYFGRPYEGIAVFDGKKITVTGTLWNGNKIIDERLITPDGSMLFRVTINP

SEQ ID NO: 1265 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1266 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRLYEGIAVFDGKKITVTGTLWNGNKIIDERLITPDGSMLFRVTINP

SEQ ID NO: 1267 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1268 - protein, 159 aa, Artificial Sequence
  Synthetic
MVFTLEDFVGDWEQTAAYNLDQVLEQGGVSSLFQNLAVSVTPIQRIVLSDENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1269 - DNA, 444 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgac

SEQ ID NO: 1270 - protein, 148 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPD

SEQ ID NO: 1271 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1272 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 1273 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 1274 - protein, 159 aa, Artificial Sequence
  Synthetic
MVFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 1275 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1276 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1277 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1278 - protein, 159 aa, Artificial Sequence
  Synthetic
MVFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1279 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1280 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINP

SEQ ID NO: 1281 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1282 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINP

SEQ ID NO: 1283 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1284 - protein, 159 aa, Artificial Sequence
  Synthetic
MVFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINS

SEQ ID NO: 1285 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1286 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINS

SEQ ID NO: 1287 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1288 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINS

SEQ ID NO: 1289 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1290 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 1291 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1292 - protein, 159 aa, Artificial Sequence
  Synthetic
MVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 1293 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1294 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEKVFKVVYPVDDHHFKVILPYGTLVIDGVTPNMLNYFGRPYEGIAVFDGKKITVTGTLWNGNKIIDERLITPDGSMLFRVTINS

SEQ ID NO: 1295 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1296 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEEIFKVVYPVDDHHFKVILPYGTLVIDGVTPNMLNYFGRPYEGIAVFDGKKITVTGTLWNGNKIIDERLITPDGSMLFRVTINS

SEQ ID NO: 1297 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1298 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMINYFGRPYEGIAVFDGKKITVTGTLWNGNKIIDERLITPDGSMLFRVTINS

SEQ ID NO: 1299 - DNA, 474 bp, Artificial Sequence
  Synthetic
gtcttcacactcgaagatttcgttggggactggcaacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1300 - protein, 158 aa, Artificial Sequence
  Synthetic
VFTLEDFVGDWNQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1301 - DNA, 474 bp, Artificial Sequence
  Synthetic
gtcttcacactcgaagatttcgttggggactggcgacagatcgccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1302 - protein, 158 aa, Artificial Sequence
  Synthetic
VFTLEDFVGDWRQIAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1303 - DNA, 474 bp, Artificial Sequence
  Synthetic
gtcttcacactcgaagatttcgttggggactggcgacagacagccagctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1304 - protein, 158 aa, Artificial Sequence
  Synthetic
VFTLEDFVGDWRQTASYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1305 - DNA, 474 bp, Artificial Sequence
  Synthetic
gtcttcacactcgaagatttcgttggggactggcgacagacagccggctacaaccaggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1306 - protein, 158 aa, Artificial Sequence
  Synthetic
VFTLEDFVGDWRQTAGYNQDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1307 - DNA, 474 bp, Artificial Sequence
  Synthetic
gtcttcacactcgaagatttcgttggggactggcgacagacagccggctacaacctggacaaggtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1308 - protein, 158 aa, Artificial Sequence
  Synthetic
VFTLEDFVGDWRQTAGYNLDKVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1309 - DNA, 474 bp, Artificial Sequence
  Synthetic
gtcttcacactcgaagatttcgttggggactggcgacagacagccggctacaacctggaccaagtccttgaacagggaggtatgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1310 - protein, 158 aa, Artificial Sequence
  Synthetic
VFTLEDFVGDWRQTAGYNLDQVLEQGGMSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1311 - DNA, 474 bp, Artificial Sequence
  Synthetic
gtcttcacactcgaagatttcgttggggactggcgacagacagccggctacaacctggaccaagtccttgaacagggaggtgtgtccagtttgatacagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1312 - protein, 158 aa, Artificial Sequence
  Synthetic
VFTLEDFVGDWRQTAGYNLDQVLEQGGVSSLIQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1313 - DNA, 474 bp, Artificial Sequence
  Synthetic
gtcttcacactcgaagatttcgttggggactggcgacagacagccggctacaacctggaccaagtccttgaacagggaggtgtgtccagtttgttgcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1314 - protein, 158 aa, Artificial Sequence
  Synthetic
VFTLEDFVGDWRQTAGYNLDQVLEQGGVSSLLQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1315 - DNA, 474 bp, Artificial Sequence
  Synthetic
gtcttcacactcgaagatttcgttggggactggcgacagacagccggctacaacctggaccaagtccttgaacagggaggtgtgtccagtttggttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1316 - protein, 158 aa, Artificial Sequence
  Synthetic
VFTLEDFVGDWRQTAGYNLDQVLEQGGVSSLVQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1317 - DNA, 474 bp, Artificial Sequence
  Synthetic
gtcttcacactcgaagatttcgttggggactggcgacagacagccggctacaacctggaccaagtccttgaacagggaggtgtgtccagtttgtttcggaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1318 - protein, 158 aa, Artificial Sequence
  Synthetic
VFTLEDFVGDWRQTAGYNLDQVLEQGGVSSLFRNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1319 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaaactcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1320 - protein, 158 aa, Artificial Sequence
  Synthetic
VFTLEDFVGDWRQTAGYNLDQVLEQGGVSSLFQKLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1321 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagcggctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1322 - protein, 158 aa, Artificial Sequence
  Synthetic
VFTLEDFVGDWRQTAGYNLDQVLEQGGVSSLFQRLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1323 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacaaccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1324 - protein, 158 aa, Artificial Sequence
  Synthetic
VFTLEDFVGDWRQTAGYNLDQVLEQGGVSSLFQNLGVSVTPIQRIVLSGENGLKIDNHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1325 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgccatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1326 - protein, 158 aa, Artificial Sequence
  Synthetic
VFTLEDFVGDWRQTAGYNLDQVLEQGGVSSLFQNLGVSVTPIQRIVLSGENGLKIDIHAIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1327 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcaccatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1328 - protein, 158 aa, Artificial Sequence
  Synthetic
VFTLEDFVGDWRQTAGYNLDQVLEQGGVSSLFQNLGVSVTPIQRIVLSGENGLKIDIHVTIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1329 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcagcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1330 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSSDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1331 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgacgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1332 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSDDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1333 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1334 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 1335 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1336 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 1337 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacattatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1338 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 1339 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1340 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 1341 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacagccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1342 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGQPYEGIAVFDGKKITVTGTLWNGNKIIDERLINPDGSLLFRVTINV

SEQ ID NO: 1343 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 1344 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 1345 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1346 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 1347 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcgacgtt

SEQ ID NO: 1348 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIDV

SEQ ID NO: 1349 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcagcgtt

SEQ ID NO: 1350 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTISV

SEQ ID NO: 1351 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgat

SEQ ID NO: 1352 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 1353 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 1354 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 1355 - DNA, 474 bp, Artificial Sequence
  Synthetic
gtcttcacactcgaagatttcgttgccgactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1356 - protein, 158 aa, Artificial Sequence
  Synthetic
VFTLEDFVADWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1357 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1358 - protein, 158 aa, Artificial Sequence
  Synthetic
VFTLEDFVGDWRQTAAYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1359 - DNA, 474 bp, Artificial Sequence
  Synthetic
gtcttcacactcgaagatttcgttggggactggcgacagacagccggctacaacctggaccaagtccttgaacaggccggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1360 - protein, 158 aa, Artificial Sequence
  Synthetic
VFTLEDFVGDWRQTAGYNLDQVLEQAGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1361 - DNA, 474 bp, Artificial Sequence
  Synthetic
gtcttcacactcgaagatttcgttggggactggcgacagacagccggctacaacctggaccaagtccttgaacagggagccgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1362 - protein, 158 aa, Artificial Sequence
  Synthetic
VFTLEDFVGDWRQTAGYNLDQVLEQGAVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1363 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1364 - protein, 158 aa, Artificial Sequence
  Synthetic
VFTLEDFVGDWRQTAGYNLDQVLEQGGVSSLFQNLAVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1365 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcgccgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1366 - protein, 158 aa, Artificial Sequence
  Synthetic
VFTLEDFVGDWRQTAGYNLDQVLEQGGVSSLFQNLGVSVTPIQRIVLSAENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1367 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1368 - protein, 158 aa, Artificial Sequence
  Synthetic
VFTLEDFVGDWRQTAGYNLDQVLEQGGVSSLFQNLGVSVTPIQRIVLSGENALKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1369 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaagccctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1370 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEALSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1371 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1372 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1373 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1374 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1375 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatgccacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1376 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYATLVIDGVTPNMIDYFGRPYEGIAVFDGKKITVTGTLWNGNKIIDERLINPDGSLLFRVTINV

SEQ ID NO: 1377 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacgccgttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1378 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDAVTPNMIDYFGRPYEGIAVFDGKKITVTGTLWNGNKIIDERLINPDGSLLFRVTINV

SEQ ID NO: 1379 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcgcccggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1380 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFARPYEGIAVFDGKKITVTGTLWNGNKIIDERLINPDGSLLFRVTINV

SEQ ID NO: 1381 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaagccatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1382 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEAIAVFDGKKITVTGTLWNGNKIIDERLINPDGSLLFRVTINV

SEQ ID NO: 1383 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacgccaaaaagatcactgtaacagggaccctgtggaacggcaacaaaattatcgacgagcgcctgatcaaccccgacggctccctgctgttccgagtaaccatcaacgtt

SEQ ID NO: 1384 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDAKKITVTGTLWNGNKIIDERLINPDGSLLFRVTINV

SEQ ID NO: 1385 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagccaccctgtggaacggcaacaaaattatcgacgagcgcctgatcaaccccgacggctccctgctgttccgagtaaccatcaacgtt

SEQ ID NO: 1386 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTATLWNGNKIIDERLINPDGSLLFRVTINV

SEQ ID NO: 1387 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacgccaacaaaattatcgacgagcgcctgatcaaccccgacggctccctgctgttccgagtaaccatcaacgtt

SEQ ID NO: 1388 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNANKIIDERLINPDGSLLFRVTINV

SEQ ID NO: 1389 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacgcctccctgctgttccgagtaaccatcaacgtt

SEQ ID NO: 1390 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDASLLFRVTINV

SEQ ID NO: 1391 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaaggccgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1392 - protein, 158 aa, Artificial Sequence
  Synthetic
VFTLEDFVGDWRQTAGYNLDQVLEQGGVSSLFQNLGVSVTPIQRIVLSGENGLKADIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1393 - DNA, 474 bp, Artificial Sequence
  Synthetic
gtcttcacactcgaagatttcgttggggactggcgacagacagccgcctacaacctggcccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1394 - protein, 158 aa, Artificial Sequence
  Synthetic
VFTLEDFVGDWRQTAAYNLAQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1395 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1396 - protein, 158 aa, Artificial Sequence
  Synthetic
VFTLEDFVGDWRQTAAYNLDQVLEQGGVSSLFQNLAVSVTPIQRIVLSGENGLKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1397 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1398 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1399 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1400 - protein, 158 aa, Artificial Sequence
  Synthetic
VFTLEDFVGDWRQTAGYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1401 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1402 - protein, 158 aa, Artificial Sequence
  Synthetic
VFTLEDFVGDWRQTAAYNLDQVLEQGGVSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1403 - DNA, 474 bp, Artificial Sequence; identical to SEQ ID NO: 1395
  Synthetic

SEQ ID NO: 1404 - protein, 158 aa, Artificial Sequence; identical to SEQ ID NO: 1396
  Synthetic

SEQ ID NO: 1405 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1406 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1407 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1408 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1409 - DNA, 474 bp, Artificial Sequence
  Synthetic
gtcttcacactcgaagatttcgttggggactgggcccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1410 - protein, 158 aa, Artificial Sequence
  Synthetic
VFTLEDFVGDWAQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1411 - DNA, 474 bp, Artificial Sequence
  Synthetic
gtcttcacactcgaagatttcgttggggactggtgccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1412 - protein, 158 aa, Artificial Sequence
  Synthetic
VFTLEDFVGDWCQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1413 - DNA, 474 bp, Artificial Sequence
  Synthetic
gtcttcacactcgaagatttcgttggggactgggaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1414 - protein, 158 aa, Artificial Sequence
  Synthetic
VFTLEDFVGDWDQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1415 - DNA, 474 bp, Artificial Sequence
  Synthetic
gtcttcacactcgaagatttcgttggggactgggagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1416 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1417 - DNA, 474 bp, Artificial Sequence
  Synthetic
gtcttcacactcgaagatttcgttggggactggttccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1418 - protein, 158 aa, Artificial Sequence
  Synthetic
VFTLEDFVGDWFQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1419 - DNA, 474 bp, Artificial Sequence
  Synthetic
gtcttcacactcgaagatttcgttggggactggggccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1420 - protein, 158 aa, Artificial Sequence
  Synthetic
VFTLEDFVGDWGQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1421 - DNA, 474 bp, Artificial Sequence
  Synthetic
gtcttcacactcgaagatttcgttggggactggcaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1422 - protein, 158 aa, Artificial Sequence
  Synthetic
VFTLEDFVGDWHQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1423 - DNA, 474 bp, Artificial Sequence
  Synthetic
gtcttcacactcgaagatttcgttggggactggatccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1424 - protein, 158 aa, Artificial Sequence
  Synthetic
VFTLEDFVGDWIQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1425 - DNA, 474 bp, Artificial Sequence
  Synthetic
gtcttcacactcgaagatttcgttggggactggaagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1426 - protein, 158 aa, Artificial Sequence
  Synthetic
VFTLEDFVGDWKQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1427 - DNA, 474 bp, Artificial Sequence
  Synthetic
gtcttcacactcgaagatttcgttggggactggctgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1428 - protein, 158 aa, Artificial Sequence
  Synthetic
VFTLEDFVGDWLQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1429 - DNA, 474 bp, Artificial Sequence
  Synthetic
gtcttcacactcgaagatttcgttggggactggatgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1430 - protein, 158 aa, Artificial Sequence
  Synthetic
VFTLEDFVGDWMQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1431 - DNA, 474 bp, Artificial Sequence
  Synthetic
gtcttcacactcgaagatttcgttggggactggaaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1432 - protein, 158 aa, Artificial Sequence
  Synthetic
VFTLEDFVGDWNQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1433 - DNA, 474 bp, Artificial Sequence
  Synthetic
gtcttcacactcgaagatttcgttggggactggccccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1434 - protein, 158 aa, Artificial Sequence
  Synthetic
VFTLEDFVGDWPQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1435 - DNA, 474 bp, Artificial Sequence
  Synthetic
gtcttcacactcgaagatttcgttggggactggcagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1436 - protein, 158 aa, Artificial Sequence
  Synthetic
VFTLEDFVGDWQQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1437 - DNA, 474 bp, Artificial Sequence
  Synthetic
gtcttcacactcgaagatttcgttggggactggagccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1438 - protein, 158 aa, Artificial Sequence
  Synthetic
VFTLEDFVGDWSQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1439 - DNA, 474 bp, Artificial Sequence
  Synthetic
gtcttcacactcgaagatttcgttggggactggacccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1440 - protein, 158 aa, Artificial Sequence
  Synthetic
VFTLEDFVGDWTQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1441 - DNA, 474 bp, Artificial Sequence
  Synthetic
gtcttcacactcgaagatttcgttggggactgggtgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1442 - protein, 158 aa, Artificial Sequence
  Synthetic
VFTLEDFVGDWVQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1443 - DNA, 474 bp, Artificial Sequence
  Synthetic
gtcttcacactcgaagatttcgttggggactggtggcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1444 - protein, 158 aa, Artificial Sequence
  Synthetic
VFTLEDFVGDWWQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1445 - DNA, 474 bp, Artificial Sequence
  Synthetic
gtcttcacactcgaagatttcgttggggactggtaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1446 - protein, 158 aa, Artificial Sequence
  Synthetic
VFTLEDFVGDWYQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1447 - DNA, 474 bp, Artificial Sequence
  Synthetic
gtcttcacactcgaagatttcgttggggactggcgacagacagcctgctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1448 - protein, 158 aa, Artificial Sequence
  Synthetic
VFTLEDFVGDWRQTACYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1449 - DNA, 474 bp, Artificial Sequence
  Synthetic
gtcttcacactcgaagatttcgttggggactggcgacagacagccgactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1450 - protein, 158 aa, Artificial Sequence
  Synthetic
VFTLEDFVGDWRQTADYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1451 - DNA, 474 bp, Artificial Sequence
  Synthetic
gtcttcacactcgaagatttcgttggggactggcgacagacagccgagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1452 - protein, 158 aa, Artificial Sequence
  Synthetic
VFTLEDFVGDWRQTAEYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1453 - DNA, 474 bp, Artificial Sequence
  Synthetic
gtcttcacactcgaagatttcgttggggactggcgacagacagccttctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1454 - protein, 158 aa, Artificial Sequence
  Synthetic
VFTLEDFVGDWRQTAFYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1455 - DNA, 474 bp, Artificial Sequence; identical to SEQ ID NO: 1399
  Synthetic

SEQ ID NO: 1456 - protein, 158 aa, Artificial Sequence; identical to SEQ ID NO: 1400
  Synthetic

SEQ ID NO: 1457 - DNA, 474 bp, Artificial Sequence
  Synthetic
gtcttcacactcgaagatttcgttggggactggcgacagacagcccactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1458 - protein, 158 aa, Artificial Sequence
  Synthetic
VFTLEDFVGDWRQTAHYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1459 - DNA, 474 bp, Artificial Sequence
  Synthetic
gtcttcacactcgaagatttcgttggggactggcgacagacagccatctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1460 - protein, 158 aa, Artificial Sequence
  Synthetic
VFTLEDFVGDWRQTAIYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1461 - DNA, 474 bp, Artificial Sequence
  Synthetic
gtcttcacactcgaagatttcgttggggactggcgacagacagccaagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1462 - protein, 158 aa, Artificial Sequence
  Synthetic
VFTLEDFVGDWRQTAKYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1463 - DNA, 474 bp, Artificial Sequence
  Synthetic
gtcttcacactcgaagatttcgttggggactggcgacagacagccctgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1464 - protein, 158 aa, Artificial Sequence
  Synthetic
VFTLEDFVGDWRQTALYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1465 - DNA, 474 bp, Artificial Sequence
  Synthetic
gtcttcacactcgaagatttcgttggggactggcgacagacagccatgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1466 - protein, 158 aa, Artificial Sequence
  Synthetic
VFTLEDFVGDWRQTAMYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1467 - DNA, 474 bp, Artificial Sequence
  Synthetic
gtcttcacactcgaagatttcgttggggactggcgacagacagccaactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1468 - protein, 158 aa, Artificial Sequence
  Synthetic
VFTLEDFVGDWRQTANYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1469 - DNA, 474 bp, Artificial Sequence
  Synthetic
gtcttcacactcgaagatttcgttggggactggcgacagacagccccctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1470 - protein, 158 aa, Artificial Sequence
  Synthetic
VFTLEDFVGDWRQTAPYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1471 - DNA, 474 bp, Artificial Sequence
  Synthetic
gtcttcacactcgaagatttcgttggggactggcgacagacagcccagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1472 - protein, 158 aa, Artificial Sequence
  Synthetic
VFTLEDFVGDWRQTAQYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1473 - DNA, 474 bp, Artificial Sequence
  Synthetic
gtcttcacactcgaagatttcgttggggactggcgacagacagcccggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1474 - protein, 158 aa, Artificial Sequence
  Synthetic
VFTLEDFVGDWRQTARYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1475 - DNA, 474 bp, Artificial Sequence
  Synthetic
gtcttcacactcgaagatttcgttggggactggcgacagacagccagctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1476 - protein, 158 aa, Artificial Sequence
  Synthetic
VFTLEDFVGDWRQTASYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1477 - DNA, 474 bp, Artificial Sequence
  Synthetic
gtcttcacactcgaagatttcgttggggactggcgacagacagccacctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1478 - protein, 158 aa, Artificial Sequence
  Synthetic
VFTLEDFVGDWRQTATYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1479 - DNA, 474 bp, Artificial Sequence
  Synthetic
gtcttcacactcgaagatttcgttggggactggcgacagacagccgtgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1480 - protein, 158 aa, Artificial Sequence
  Synthetic
VFTLEDFVGDWRQTAVYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1481 - DNA, 474 bp, Artificial Sequence
  Synthetic
gtcttcacactcgaagatttcgttggggactggcgacagacagcctggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1482 - protein, 158 aa, Artificial Sequence
  Synthetic
VFTLEDFVGDWRQTAWYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1483 - DNA, 474 bp, Artificial Sequence
  Synthetic
gtcttcacactcgaagatttcgttggggactggcgacagacagcctactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1484 - protein, 158 aa, Artificial Sequence
  Synthetic
VFTLEDFVGDWRQTAYYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1485 - DNA, 474 bp, Artificial Sequence
  Synthetic
gtcttcacactcgaagatttcgttggggactggcgacagacagccgcctacaacgccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1486 - protein, 158 aa, Artificial Sequence
  Synthetic
VFTLEDFVGDWRQTAAYNADQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1487 - DNA, 474 bp, Artificial Sequence
  Synthetic
gtcttcacactcgaagatttcgttggggactggcgacagacagccgcctacaactgcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1488 - protein, 158 aa, Artificial Sequence
  Synthetic
VFTLEDFVGDWRQTAAYNCDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1489 - DNA, 474 bp, Artificial Sequence
  Synthetic
gtcttcacactcgaagatttcgttggggactggcgacagacagccgcctacaacgacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1490 - protein, 158 aa, Artificial Sequence
  Synthetic
VFTLEDFVGDWRQTAAYNDDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1491 - DNA, 474 bp, Artificial Sequence
  Synthetic
gtcttcacactcgaagatttcgttggggactggcgacagacagccgcctacaacgaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1492 - protein, 158 aa, Artificial Sequence
  Synthetic
VFTLEDFVGDWRQTAAYNEDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1493 - DNA, 474 bp, Artificial Sequence
  Synthetic
gtcttcacactcgaagatttcgttggggactggcgacagacagccgcctacaacttcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1494 - protein, 158 aa, Artificial Sequence
  Synthetic
VFTLEDFVGDWRQTAAYNFDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1495 - DNA, 474 bp, Artificial Sequence
  Synthetic
gtcttcacactcgaagatttcgttggggactggcgacagacagccgcctacaacggcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1496 - protein, 158 aa, Artificial Sequence
  Synthetic
VFTLEDFVGDWRQTAAYNGDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1497 - DNA, 474 bp, Artificial Sequence
  Synthetic
gtcttcacactcgaagatttcgttggggactggcgacagacagccgcctacaaccacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1498 - protein, 158 aa, Artificial Sequence
  Synthetic
VFTLEDFVGDWRQTAAYNHDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1499 - DNA, 474 bp, Artificial Sequence
  Synthetic
gtcttcacactcgaagatttcgttggggactggcgacagacagccgcctacaacatcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1500 - protein, 158 aa, Artificial Sequence
  Synthetic
VFTLEDFVGDWRQTAAYNIDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1501 - DNA, 474 bp, Artificial Sequence
  Synthetic
gtcttcacactcgaagatttcgttggggactggcgacagacagccgcctacaacaaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1502 - protein, 158 aa, Artificial Sequence
  Synthetic
VFTLEDFVGDWRQTAAYNKDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1503 - DNA, 474 bp, Artificial Sequence
  Synthetic
gtcttcacactcgaagatttcgttggggactggcgacagacagccgcctacaacatggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1504 - protein, 158 aa, Artificial Sequence
  Synthetic
VFTLEDFVGDWRQTAAYNMDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1505 - DNA, 474 bp, Artificial Sequence
  Synthetic
gtcttcacactcgaagatttcgttggggactggcgacagacagccgcctacaacaacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1506 - protein, 158 aa, Artificial Sequence
  Synthetic
VFTLEDFVGDWRQTAAYNNDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1507 - DNA, 474 bp, Artificial Sequence
  Synthetic
gtcttcacactcgaagatttcgttggggactggcgacagacagccgcctacaaccccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1508 - protein, 158 aa, Artificial Sequence
  Synthetic
VFTLEDFVGDWRQTAAYNPDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1509 - DNA, 474 bp, Artificial Sequence
  Synthetic
gtcttcacactcgaagatttcgttggggactggcgacagacagccgcctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1510 - protein, 158 aa, Artificial Sequence
  Synthetic
VFTLEDFVGDWRQTAAYNQDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1511 - DNA, 474 bp, Artificial Sequence
  Synthetic
gtcttcacactcgaagatttcgttggggactggcgacagacagccgcctacaaccgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1512 - protein, 158 aa, Artificial Sequence
  Synthetic
VFTLEDFVGDWRQTAAYNRDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1513 - DNA, 474 bp, Artificial Sequence
  Synthetic
gtcttcacactcgaagatttcgttggggactggcgacagacagccgcctacaacagcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1514 - protein, 158 aa, Artificial Sequence
  Synthetic
VFTLEDFVGDWRQTAAYNSDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1515 - DNA, 474 bp, Artificial Sequence
  Synthetic
gtcttcacactcgaagatttcgttggggactggcgacagacagccgcctacaacaccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1516 - protein, 158 aa, Artificial Sequence
  Synthetic
VFTLEDFVGDWRQTAAYNTDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1517 - DNA, 474 bp, Artificial Sequence
  Synthetic
gtcttcacactcgaagatttcgttggggactggcgacagacagccgcctacaacgtggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1518 - protein, 158 aa, Artificial Sequence
  Synthetic
VFTLEDFVGDWRQTAAYNVDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1519 - DNA, 474 bp, Artificial Sequence
  Synthetic
gtcttcacactcgaagatttcgttggggactggcgacagacagccgcctacaactgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1520 - protein, 158 aa, Artificial Sequence
  Synthetic
VFTLEDFVGDWRQTAAYNWDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1521 - DNA, 474 bp, Artificial Sequence
  Synthetic
gtcttcacactcgaagatttcgttggggactggcgacagacagccgcctacaactacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1522 - protein, 158 aa, Artificial Sequence
  Synthetic
VFTLEDFVGDWRQTAAYNYDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1523 - DNA, 474 bp, Artificial Sequence
  Synthetic
gtcttcacactcgaagatttcgttggggactggcgacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1524 - protein, 158 aa, Artificial Sequence
  Synthetic
VFTLEDFVGDWRQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1525 - DNA, 474 bp, Artificial Sequence
  Synthetic
gtcttcacactcgaagatttcgttggggactggcgacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1526 - protein, 158 aa, Artificial Sequence
  Synthetic
VFTLEDFVGDWRQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1527 - DNA, 474 bp, Artificial Sequence
  Synthetic
gtcttcacactcgaagatttcgttggggactggcgacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1528 - protein, 158 aa, Artificial Sequence
  Synthetic
VFTLEDFVGDWRQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1529 - DNA, 474 bp, Artificial Sequence
  Synthetic
gtcttcacactcgaagatttcgttggggactggcgacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1530 - protein, 158 aa, Artificial Sequence
  Synthetic
VFTLEDFVGDWRQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1531 - DNA, 474 bp, Artificial Sequence
  Synthetic
gtcttcacactcgaagatttcgttggggactggcgacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1532 - protein, 158 aa, Artificial Sequence
  Synthetic
VFTLEDFVGDWRQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1533 - DNA, 474 bp, Artificial Sequence
  Synthetic
gtcttcacactcgaagatttcgttggggactggcgacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1534 - protein, 158 aa, Artificial Sequence
  Synthetic
VFTLEDFVGDWRQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1535 - DNA, 474 bp, Artificial Sequence
  Synthetic
gtcttcacactcgaagatttcgttggggactggcgacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1536 - protein, 158 aa, Artificial Sequence
  Synthetic
VFTLEDFVGDWRQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1537 - DNA, 474 bp, Artificial Sequence
  Synthetic
gtcttcacactcgaagatttcgttggggactggcgacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1538 - protein, 158 aa, Artificial Sequence
  Synthetic
VFTLEDFVGDWRQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1539 - DNA, 474 bp, Artificial Sequence
  Synthetic
gtcttcacactcgaagatttcgttggggactggcgacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1540 - protein, 158 aa, Artificial Sequence
  Synthetic
VFTLEDFVGDWRQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1541 - DNA, 474 bp, Artificial Sequence
  Synthetic
gtcttcacactcgaagatttcgttggggactggcgacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1542 - protein, 158 aa, Artificial Sequence
  Synthetic
VFTLEDFVGDWRQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1543 - DNA, 474 bp, Artificial Sequence
  Synthetic
gtcttcacactcgaagatttcgttggggactggcgacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1544 - protein, 158 aa, Artificial Sequence
  Synthetic
VFTLEDFVGDWRQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1545 - DNA, 474 bp, Artificial Sequence
  Synthetic
gtcttcacactcgaagatttcgttggggactggcgacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1546 - protein, 158 aa, Artificial Sequence
  Synthetic
VFTLEDFVGDWRQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1547 - DNA, 474 bp, Artificial Sequence
  Synthetic
gtcttcacactcgaagatttcgttggggactggcgacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1548 - protein, 158 aa, Artificial Sequence
  Synthetic
VFTLEDFVGDWRQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1549 - DNA, 474 bp, Artificial Sequence
  Synthetic
gtcttcacactcgaagatttcgttggggactggcgacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1550 - protein, 158 aa, Artificial Sequence
  Synthetic
VFTLEDFVGDWRQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1551 - DNA, 474 bp, Artificial Sequence
  Synthetic
gtcttcacactcgaagatttcgttggggactggcgacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1552 - protein, 158 aa, Artificial Sequence
  Synthetic
VFTLEDFVGDWRQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1553 - DNA, 474 bp, Artificial Sequence
  Synthetic
gtcttcacactcgaagatttcgttggggactggcgacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1554 - protein, 158 aa, Artificial Sequence
  Synthetic
VFTLEDFVGDWRQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1555 - DNA, 474 bp, Artificial Sequence
  Synthetic
gtcttcacactcgaagatttcgttggggactggcgacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1556 - protein, 158 aa, Artificial Sequence
  Synthetic
VFTLEDFVGDWRQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1557 - DNA, 474 bp, Artificial Sequence
  Synthetic
gtcttcacactcgaagatttcgttggggactggcgacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1558 - protein, 158 aa, Artificial Sequence
  Synthetic
VFTLEDFVGDWRQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1559 - DNA, 474 bp, Artificial Sequence
  Synthetic
gtcttcacactcgaagatttcgttggggactggcgacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1560 - protein, 158 aa, Artificial Sequence
  Synthetic
VFTLEDFVGDWRQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1561 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1562 - protein, 158 aa, Artificial Sequence
  Synthetic
VFTLEDFVGDWRQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1563 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattgcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1564 - protein, 158 aa, Artificial Sequence
  Synthetic
VFTLEDFVGDWRQTAAYNLDQVLEQGGVSSLFQNLAVSVTPIQRIVLSGENALKIDIHCIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1565 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1566 - protein, 158 aa, Artificial Sequence
  Synthetic
VFTLEDFVGDWRQTAAYNLDQVLEQGGVSSLFQNLAVSVTPIQRIVLSGENALKIDIHDIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1567 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1568 - protein, 158 aa, Artificial Sequence
  Synthetic
VFTLEDFVGDWRQTAAYNLDQVLEQGGVSSLFQNLAVSVTPIQRIVLSGENALKIDIHEIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1569 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatttcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1570 - protein, 158 aa, Artificial Sequence
  Synthetic
VFTLEDFVGDWRQTAAYNLDQVLEQGGVSSLFQNLAVSVTPIQRIVLSGENALKIDIHFIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1571 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatggcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1572 - protein, 158 aa, Artificial Sequence
  Synthetic
VFTLEDFVGDWRQTAAYNLDQVLEQGGVSSLFQNLAVSVTPIQRIVLSGENALKIDIHGIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1573 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1574 - protein, 158 aa, Artificial Sequence
  Synthetic
VFTLEDFVGDWRQTAAYNLDQVLEQGGVSSLFQNLAVSVTPIQRIVLSGENALKIDIHHIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1575 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1576 - protein, 158 aa, Artificial Sequence
  Synthetic
VFTLEDFVGDWRQTAAYNLDQVLEQGGVSSLFQNLAVSVTPIQRIVLSGENALKIDIHIIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1577 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1578 - protein, 158 aa, Artificial Sequence
  Synthetic
VFTLEDFVGDWRQTAAYNLDQVLEQGGVSSLFQNLAVSVTPIQRIVLSGENALKIDIHKIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1579 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatctgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1580 - protein, 158 aa, Artificial Sequence
  Synthetic
VFTLEDFVGDWRQTAAYNLDQVLEQGGVSSLFQNLAVSVTPIQRIVLSGENALKIDIHLIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1581 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1582 - protein, 158 aa, Artificial Sequence
  Synthetic
VFTLEDFVGDWRQTAAYNLDQVLEQGGVSSLFQNLAVSVTPIQRIVLSGENALKIDIHMIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1583 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1584 - protein, 158 aa, Artificial Sequence
  Synthetic
VFTLEDFVGDWRQTAAYNLDQVLEQGGVSSLFQNLAVSVTPIQRIVLSGENALKIDIHNIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1585 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1586 - protein, 158 aa, Artificial Sequence
  Synthetic
VFTLEDFVGDWRQTAAYNLDQVLEQGGVSSLFQNLAVSVTPIQRIVLSGENALKIDIHPIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1587 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1588 - protein, 158 aa, Artificial Sequence
  Synthetic
VFTLEDFVGDWRQTAAYNLDQVLEQGGVSSLFQNLAVSVTPIQRIVLSGENALKIDIHQIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1589 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1590 - protein, 158 aa, Artificial Sequence
  Synthetic
VFTLEDFVGDWRQTAAYNLDQVLEQGGVSSLFQNLAVSVTPIQRIVLSGENALKIDIHRIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1591 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatagcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1592 - protein, 158 aa, Artificial Sequence
  Synthetic
VFTLEDFVGDWRQTAAYNLDQVLEQGGVSSLFQNLAVSVTPIQRIVLSGENALKIDIHSIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1593 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1594 - protein, 158 aa, Artificial Sequence
  Synthetic
VFTLEDFVGDWRQTAAYNLDQVLEQGGVSSLFQNLAVSVTPIQRIVLSGENALKIDIHTIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1595 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1596 - protein, 158 aa, Artificial Sequence
  Synthetic
VFTLEDFVGDWRQTAAYNLDQVLEQGGVSSLFQNLAVSVTPIQRIVLSGENALKIDIHWIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1597 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1598 - protein, 158 aa, Artificial Sequence
  Synthetic
VFTLEDFVGDWRQTAAYNLDQVLEQGGVSSLFQNLAVSVTPIQRIVLSGENALKIDIHYIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1599 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1600 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSCDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1601 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1602 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSDDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1603 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1604 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSEDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1605 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcttcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1606 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSFDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1607 - DNA, 474 bp, Artificial Sequence; identical to SEQ ID NO: 1405
  Synthetic

SEQ ID NO: 1608 - protein, 158 aa, Artificial Sequence; identical to SEQ ID NO: 1406
  Synthetic

SEQ ID NO: 1609 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1610 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSHDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1611 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1612 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSIDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1613 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1614 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSKDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1615 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcctggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1616 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSLDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1617 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1618 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSMDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1619 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1620 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSNDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1621 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1622 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSPDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1623 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1624 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSQDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1625 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1626 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSRDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1627 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcagcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1628 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSSDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1629 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1630 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSTDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1631 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgtggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1632 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSVDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1633 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1634 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSWDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1635 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1636 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSYDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1637 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1638 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNAIDYFGRPYEGIAVFDGKKITVTGTLWNGNKIIDERLINPDGSLLFRVTINV

SEQ ID NO: 1639 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactgcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1640 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNCIDYFGRPYEGIAVFDGKKITVTGTLWNGNKIIDERLINPDGSLLFRVTINV

SEQ ID NO: 1641 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1642 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNDIDYFGRPYEGIAVFDGKKITVTGTLWNGNKIIDERLINPDGSLLFRVTINV

SEQ ID NO: 1643 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1644 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNEIDYFGRPYEGIAVFDGKKITVTGTLWNGNKIIDERLINPDGSLLFRVTINV

SEQ ID NO: 1645 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacttcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1646 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNFIDYFGRPYEGIAVFDGKKITVTGTLWNGNKIIDERLINPDGSLLFRVTINV

SEQ ID NO: 1647 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacggcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1648 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNGIDYFGRPYEGIAVFDGKKITVTGTLWNGNKIIDERLINPDGSLLFRVTINV

SEQ ID NO: 1649 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1650 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNHIDYFGRPYEGIAVFDGKKITVTGTLWNGNKIIDERLINPDGSLLFRVTINV

SEQ ID NO: 1651 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1652 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 1653 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1654 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNKIDYFGRPYEGIAVFDGKKITVTGTLWNGNKIIDERLINPDGSLLFRVTINV

SEQ ID NO: 1655 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacctgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1656 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNLIDYFGRPYEGIAVFDGKKITVTGTLWNGNKIIDERLINPDGSLLFRVTINV

SEQ ID NO: 1657 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1658 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNNIDYFGRPYEGIAVFDGKKITVTGTLWNGNKIIDERLINPDGSLLFRVTINV

SEQ ID NO: 1659 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1660 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNPIDYFGRPYEGIAVFDGKKITVTGTLWNGNKIIDERLINPDGSLLFRVTINV

SEQ ID NO: 1661 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1662 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNQIDYFGRPYEGIAVFDGKKITVTGTLWNGNKIIDERLINPDGSLLFRVTINV

SEQ ID NO: 1663 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1664 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNRIDYFGRPYEGIAVFDGKKITVTGTLWNGNKIIDERLINPDGSLLFRVTINV

SEQ ID NO: 1665 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacagcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1666 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNSIDYFGRPYEGIAVFDGKKITVTGTLWNGNKIIDERLINPDGSLLFRVTINV

SEQ ID NO: 1667 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1668 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNTIDYFGRPYEGIAVFDGKKITVTGTLWNGNKIIDERLINPDGSLLFRVTINV

SEQ ID NO: 1669 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1670 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 1671 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1672 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNWIDYFGRPYEGIAVFDGKKITVTGTLWNGNKIIDERLINPDGSLLFRVTINV

SEQ ID NO: 1673 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1674 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNYIDYFGRPYEGIAVFDGKKITVTGTLWNGNKIIDERLINPDGSLLFRVTINV

SEQ ID NO: 1675 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgccctgttccgagtaaccatcaacgtt

SEQ ID NO: 1676 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSALFRVTINV

SEQ ID NO: 1677 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctgcctgttccgagtaaccatcaacgtt

SEQ ID NO: 1678 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSCLFRVTINV

SEQ ID NO: 1679 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgacctgttccgagtaaccatcaacgtt

SEQ ID NO: 1680 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSDLFRVTINV

SEQ ID NO: 1681 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgagctgttccgagtaaccatcaacgtt

SEQ ID NO: 1682 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSELFRVTINV

SEQ ID NO: 1683 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccttcctgttccgagtaaccatcaacgtt

SEQ ID NO: 1684 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSFLFRVTINV

SEQ ID NO: 1685 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccggcctgttccgagtaaccatcaacgtt

SEQ ID NO: 1686 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSGLFRVTINV

SEQ ID NO: 1687 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccacctgttccgagtaaccatcaacgtt

SEQ ID NO: 1688 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSHLFRVTINV

SEQ ID NO: 1689 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatcctgttccgagtaaccatcaacgtt

SEQ ID NO: 1690 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSILFRVTINV

SEQ ID NO: 1691 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaagctgttccgagtaaccatcaacgtt

SEQ ID NO: 1692 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSKLFRVTINV

SEQ ID NO: 1693 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1694 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 1695 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaacctgttccgagtaaccatcaacgtt

SEQ ID NO: 1696 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSNLFRVTINV

SEQ ID NO: 1697 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccccctgttccgagtaaccatcaacgtt

SEQ ID NO: 1698 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSPLFRVTINV

SEQ ID NO: 1699 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccagctgttccgagtaaccatcaacgtt

SEQ ID NO: 1700 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSQLFRVTINV

SEQ ID NO: 1701 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccggctgttccgagtaaccatcaacgtt

SEQ ID NO: 1702 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSRLFRVTINV

SEQ ID NO: 1703 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccagcctgttccgagtaaccatcaacgtt

SEQ ID NO: 1704 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSSLFRVTINV

SEQ ID NO: 1705 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaccctgttccgagtaaccatcaacgtt

SEQ ID NO: 1706 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSTLFRVTINV

SEQ ID NO: 1707 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgtgctgttccgagtaaccatcaacgtt

SEQ ID NO: 1708 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSVLFRVTINV

SEQ ID NO: 1709 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctggctgttccgagtaaccatcaacgtt

SEQ ID NO: 1710 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSWLFRVTINV

SEQ ID NO: 1711 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctacctgttccgagtaaccatcaacgtt

SEQ ID NO: 1712 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSYLFRVTINV

SEQ ID NO: 1713 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgcc

SEQ ID NO: 1714 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINA

SEQ ID NO: 1715 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgc

SEQ ID NO: 1716 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINC

SEQ ID NO: 1717 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 1718 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 1719 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgag

SEQ ID NO: 1720 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINE

SEQ ID NO: 1721 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacttc

SEQ ID NO: 1722 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINF

SEQ ID NO: 1723 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggc

SEQ ID NO: 1724 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTING

SEQ ID NO: 1725 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccac

SEQ ID NO: 1726 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINH

SEQ ID NO: 1727 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatc

SEQ ID NO: 1728 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINI

SEQ ID NO: 1729 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaag

SEQ ID NO: 1730 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINK

SEQ ID NO: 1731 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacctg

SEQ ID NO: 1732 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINL

SEQ ID NO: 1733 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatg

SEQ ID NO: 1734 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINM

SEQ ID NO: 1735 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaac

SEQ ID NO: 1736 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINN

SEQ ID NO: 1737 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 1738 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 1739 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccag

SEQ ID NO: 1740 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINQ

SEQ ID NO: 1741 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccgg

SEQ ID NO: 1742 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINR

SEQ ID NO: 1743 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 1744 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 1745 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacacc

SEQ ID NO: 1746 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINT

SEQ ID NO: 1747 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgg

SEQ ID NO: 1748 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINW

SEQ ID NO: 1749 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactac

SEQ ID NO: 1750 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINY

SEQ ID NO: 1751 - DNA, 474 bp, Artificial Sequence
  Synthetic
gtcttcacactcgaagatttcgttggggactggcgacagacagccgcctacaacctggacaaggtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1752 - protein, 158 aa, Artificial Sequence
  Synthetic
VFTLEDFVGDWRQTAAYNLDKVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1753 - DNA, 474 bp, Artificial Sequence
  Synthetic
gtcttcacactcgaagatttcgttggggactggcgacagacagccgcctacaacctggaccaagtccttgaacagggaggtatgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1754 - protein, 158 aa, Artificial Sequence
  Synthetic
VFTLEDFVGDWRQTAAYNLDQVLEQGGMSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1755 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaagctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1756 - protein, 158 aa, Artificial Sequence
  Synthetic
VFTLEDFVGDWRQTAAYNLDQVLEQGGVSSLFQKLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1757 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccatcactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1758 - protein, 158 aa, Artificial Sequence
  Synthetic
VFTLEDFVGDWRQTAAYNLDQVLEQGGVSSLFQNLAVSITPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1759 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1760 - protein, 158 aa, Artificial Sequence
  Synthetic
VFTLEDFVGDWRQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1761 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1762 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 1763 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 1764 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 1765 - DNA, 474 bp, Artificial Sequence
  Synthetic
gtcttcacactcgaagatttcgttggggactggcgacagacagccgcctacaacctggaccaagtccttgaacagggaggtatgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1766 - protein, 158 aa, Artificial Sequence
  Synthetic
VFTLEDFVGDWRQTAAYNLDQVLEQGGMSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1767 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1768 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 1769 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1770 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 1771 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 1772 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 1773 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 1774 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSLLFRVTINV

SEQ ID NO: 1775 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1776 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 1777 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 1778 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 1779 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 1780 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 1781 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 1782 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINP

SEQ ID NO: 1783 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1784 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINP

SEQ ID NO: 1785 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 1786 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINE

SEQ ID NO: 1787 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 1788 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINE

SEQ ID NO: 1789 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 1790 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINE

SEQ ID NO: 1791 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1792 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1793 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1794 - protein, 158 aa, Artificial Sequence
  Synthetic
VFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1795 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 1796 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 1797 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 1798 - protein, 158 aa, Artificial Sequence
  Synthetic
VFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 1799 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1800 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1801 - DNA, 474 bp, Artificial Sequence
  Synthetic
gtcttcacactcgaagatttcgttggggactggcgacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1802 - protein, 158 aa, Artificial Sequence
  Synthetic
VFTLEDFVGDWRQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1803 - DNA, 474 bp, Artificial Sequence
  Synthetic
gtcttcacactcgaagatttcgttggggactggcaacagacagccgcctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1804 - protein, 158 aa, Artificial Sequence
  Synthetic
VFTLEDFVGDWNQTAAYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1805 - DNA, 474 bp, Artificial Sequence
  Synthetic
gtcttcacactcgaagatttcgttggggactggcaacagacagccagctacaacctggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1806 - protein, 158 aa, Artificial Sequence
  Synthetic
VFTLEDFVGDWNQTASYNLDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1807 - DNA, 474 bp, Artificial Sequence
  Synthetic
gtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1808 - protein, 158 aa, Artificial Sequence
  Synthetic
VFTLEDFVGDWNQTASYNQDQVLEQGGVSSLFQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1809 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1810 - protein, 158 aa, Artificial Sequence
  Synthetic
VFTLEDFVGDWNQTASYNQDQVLEQGGVSSLIQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1811 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1812 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1813 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1814 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 1815 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 1816 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSLLFRVTIND

SEQ ID NO: 1817 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1818 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTINV

SEQ ID NO: 1819 - DNA, 474 bp, Artificial Sequence
  Synthetic
gtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1820 - protein, 158 aa, Artificial Sequence
  Synthetic
VFTLEDFVGDWRQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1821 - DNA, 474 bp, Artificial Sequence
  Synthetic
gtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1822 - protein, 158 aa, Artificial Sequence
  Synthetic
VFTLEDFVGDWRQTASYNQDQVLEQGGVSSLFQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1823 - DNA, 474 bp, Artificial Sequence
  Synthetic
gtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1824 - protein, 158 aa, Artificial Sequence
  Synthetic
VFTLEDFVGDWNQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1825 - DNA, 477 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtg

SEQ ID NO: 1826 - protein, 159 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPV

SEQ ID NO: 1827 - DNA, 477 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgcc

SEQ ID NO: 1828 - protein, 159 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPA

SEQ ID NO: 1829 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgacc

SEQ ID NO: 1830 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVT

SEQ ID NO: 1831 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtggcc

SEQ ID NO: 1832 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVA

SEQ ID NO: 1833 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccacc

SEQ ID NO: 1834 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAT

SEQ ID NO: 1835 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccgcc

SEQ ID NO: 1836 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAA

SEQ ID NO: 1837 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcggc

SEQ ID NO: 1838 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGG

SEQ ID NO: 1839 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcacc

SEQ ID NO: 1840 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGT

SEQ ID NO: 1841 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccaccggc

SEQ ID NO: 1842 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPATG

SEQ ID NO: 1843 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggc

SEQ ID NO: 1844 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTG

SEQ ID NO: 1845 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccgcc

SEQ ID NO: 1846 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTA

SEQ ID NO: 1847 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcaccgcc

SEQ ID NO: 1848 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGTA

SEQ ID NO: 1849 - DNA, 486 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgg

SEQ ID NO: 1850 - protein, 162 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGW

SEQ ID NO: 1851 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcgg

SEQ ID NO: 1852 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWR

SEQ ID NO: 1853 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgggag

SEQ ID NO: 1854 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWE

SEQ ID NO: 1855 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggaag

SEQ ID NO: 1856 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWK

SEQ ID NO: 1857 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcag

SEQ ID NO: 1858 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWQ

SEQ ID NO: 1859 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcac

SEQ ID NO: 1860 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWH

SEQ ID NO: 1861 - DNA, 471 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaac

SEQ ID NO: 1862 - protein, 157 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIN

SEQ ID NO: 1863 - DNA, 468 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatc

SEQ ID NO: 1864 - protein, 156 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTI

SEQ ID NO: 1865 - DNA, 465 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaacc

SEQ ID NO: 1866 - protein, 155 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVT

SEQ ID NO: 1867 - DNA, 462 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagta

SEQ ID NO: 1868 - protein, 154 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRV

SEQ ID NO: 1869 - DNA, 459 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccga

SEQ ID NO: 1870 - protein, 153 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFR

SEQ ID NO: 1871 - DNA, 456 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttc

SEQ ID NO: 1872 - protein, 152 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLF

SEQ ID NO: 1873 - DNA, 453 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctg

SEQ ID NO: 1874 - protein, 151 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSML

SEQ ID NO: 1875 - DNA, 474 bp, Artificial Sequence
  Synthetic
gtcttcacactcgaagatttcgttggggactgggaacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1876 - protein, 158 aa, Artificial Sequence
  Synthetic
VFTLEDFVGDWEQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1877 - DNA, 474 bp, Artificial Sequence
  Synthetic
gtcttcacactcgaagatttcgttggggactgggaacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1878 - protein, 158 aa, Artificial Sequence
  Synthetic
VFTLEDFVGDWEQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1879 - DNA, 474 bp, Artificial Sequence
  Synthetic
gtcttcacactcgaagatttcgttggggactgggaacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1880 - protein, 158 aa, Artificial Sequence
  Synthetic
VFTLEDFVGDWEQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1881 - DNA, 474 bp, Artificial Sequence
  Synthetic
gtcttcacactcgaagatttcgttggggactgggaacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1882 - protein, 158 aa, Artificial Sequence
  Synthetic
VFTLEDFVGDWEQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1883 - DNA, 474 bp, Artificial Sequence
  Synthetic
gtcttcacactcgaagatttcgttggggactgggaacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1884 - protein, 158 aa, Artificial Sequence
  Synthetic
VFTLEDFVGDWEQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1885 - DNA, 474 bp, Artificial Sequence
  Synthetic
gtcttcacactcgaagatttcgttggggactgggaacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1886 - protein, 158 aa, Artificial Sequence
  Synthetic
VFTLEDFVGDWEQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1887 - DNA, 474 bp, Artificial Sequence
  Synthetic
gtcttcacactcgaagatttcgttggggactgggaacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1888 - protein, 158 aa, Artificial Sequence
  Synthetic
VFTLEDFVGDWEQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1889 - DNA, 474 bp, Artificial Sequence
  Synthetic
gtcttcacactcgaagatttcgttggggactgggaacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1890 - protein, 158 aa, Artificial Sequence
  Synthetic
VFTLEDFVGDWEQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1891 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1892 - protein, 158 aa, Artificial Sequence
  Synthetic
VFTLEDFVGDWEQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1893 - DNA, 474 bp, Artificial Sequence
  Synthetic
gtcttcacactcgaagatttcgttggggactgggaacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1894 - protein, 158 aa, Artificial Sequence
  Synthetic
VFTLEDFVGDWEQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1895 - DNA, 474 bp, Artificial Sequence
  Synthetic
gtcttcacactcgaagatttcgttggggactgggaacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1896 - protein, 158 aa, Artificial Sequence
  Synthetic
VFTLEDFVGDWEQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1897 - DNA, 474 bp, Artificial Sequence
  Synthetic
gtcttcacactcgaagatttcgttggggactgggaacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1898 - protein, 158 aa, Artificial Sequence
  Synthetic
VFTLEDFVGDWEQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1899 - DNA, 474 bp, Artificial Sequence
  Synthetic
gtcttcacactcgaagatttcgttggggactgggaacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1900 - protein, 158 aa, Artificial Sequence
  Synthetic
VFTLEDFVGDWEQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1901 - DNA, 474 bp, Artificial Sequence
  Synthetic
gtcttcacactcgaagatttcgttggggactgggaacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1902 - protein, 158 aa, Artificial Sequence
  Synthetic
VFTLEDFVGDWEQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1903 - DNA, 474 bp, Artificial Sequence
  Synthetic
gtcttcacactcgaagatttcgttggggactgggaacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1904 - protein, 158 aa, Artificial Sequence
  Synthetic
VFTLEDFVGDWEQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1905 - DNA, 474 bp, Artificial Sequence
  Synthetic
gtcttcacactcgaagatttcgttggggactgggaacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1906 - protein, 158 aa, Artificial Sequence
  Synthetic
VFTLEDFVGDWEQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1907 - DNA, 474 bp, Artificial Sequence
  Synthetic
gtcttcacactcgaagatttcgttggggactgggaacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1908 - protein, 158 aa, Artificial Sequence
  Synthetic
VFTLEDFVGDWEQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1909 - DNA, 474 bp, Artificial Sequence
  Synthetic
gtcttcacactcgaagatttcgttggggactgggaacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1910 - protein, 158 aa, Artificial Sequence
  Synthetic
VFTLEDFVGDWEQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1911 - DNA, 474 bp, Artificial Sequence
  Synthetic
gtcttcacactcgaagatttcgttggggactgggaacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1912 - protein, 158 aa, Artificial Sequence
  Synthetic
VFTLEDFVGDWEQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1913 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1914 - protein, 158 aa, Artificial Sequence
  Synthetic
VFTLEDFVGDWEQTAAYNLDQVLEQGGVSSLFQNLAVSVTPIQRIVASGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1915 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtctgcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1916 - protein, 158 aa, Artificial Sequence
  Synthetic
VFTLEDFVGDWEQTAAYNLDQVLEQGGVSSLFQNLAVSVTPIQRIVCSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1917 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1918 - protein, 158 aa, Artificial Sequence
  Synthetic
VFTLEDFVGDWEQTAAYNLDQVLEQGGVSSLFQNLAVSVTPIQRIVDSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1919 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1920 - protein, 158 aa, Artificial Sequence
  Synthetic
VFTLEDFVGDWEQTAAYNLDQVLEQGGVSSLFQNLAVSVTPIQRIVESGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1921 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcttcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1922 - protein, 158 aa, Artificial Sequence
  Synthetic
VFTLEDFVGDWEQTAAYNLDQVLEQGGVSSLFQNLAVSVTPIQRIVFSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1923 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcggcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1924 - protein, 158 aa, Artificial Sequence
  Synthetic
VFTLEDFVGDWEQTAAYNLDQVLEQGGVSSLFQNLAVSVTPIQRIVGSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1925 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1926 - protein, 158 aa, Artificial Sequence
  Synthetic
VFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1927 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1928 - protein, 158 aa, Artificial Sequence
  Synthetic
VFTLEDFVGDWEQTAAYNLDQVLEQGGVSSLFQNLAVSVTPIQRIVISGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1929 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1930 - protein, 158 aa, Artificial Sequence
  Synthetic
VFTLEDFVGDWEQTAAYNLDQVLEQGGVSSLFQNLAVSVTPIQRIVKSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1931 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1932 - protein, 158 aa, Artificial Sequence
  Synthetic
VFTLEDFVGDWEQTAAYNLDQVLEQGGVSSLFQNLAVSVTPIQRIVMSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1933 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1934 - protein, 158 aa, Artificial Sequence
  Synthetic
VFTLEDFVGDWEQTAAYNLDQVLEQGGVSSLFQNLAVSVTPIQRIVNSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1935 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1936 - protein, 158 aa, Artificial Sequence
  Synthetic
VFTLEDFVGDWEQTAAYNLDQVLEQGGVSSLFQNLAVSVTPIQRIVPSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1937 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1938 - protein, 158 aa, Artificial Sequence
  Synthetic
VFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1939 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1940 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1941 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcagcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1942 - protein, 158 aa, Artificial Sequence
  Synthetic
VFTLEDFVGDWEQTAAYNLDQVLEQGGVSSLFQNLAVSVTPIQRIVSSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1943 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1944 - protein, 158 aa, Artificial Sequence
  Synthetic
VFTLEDFVGDWEQTAAYNLDQVLEQGGVSSLFQNLAVSVTPIQRIVTSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1945 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgtgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1946 - protein, 158 aa, Artificial Sequence
  Synthetic
VFTLEDFVGDWEQTAAYNLDQVLEQGGVSSLFQNLAVSVTPIQRIVVSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1947 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtctggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1948 - protein, 158 aa, Artificial Sequence
  Synthetic
VFTLEDFVGDWEQTAAYNLDQVLEQGGVSSLFQNLAVSVTPIQRIVWSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1949 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtctacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1950 - protein, 158 aa, Artificial Sequence
  Synthetic
VFTLEDFVGDWEQTAAYNLDQVLEQGGVSSLFQNLAVSVTPIQRIVYSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1951 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgcctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1952 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIAYFGRPYEGIAVFDGKKITVTGTLWNGNKIIDERLITPDGSMLFRVTINP

SEQ ID NO: 1953 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctgctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1954 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMICYFGRPYEGIAVFDGKKITVTGTLWNGNKIIDERLITPDGSMLFRVTINP

SEQ ID NO: 1955 - DNA, 474 bp, Artificial Sequence; identical to SEQ ID NO: 1783
  Synthetic

SEQ ID NO: 1956 - protein, 158 aa, Artificial Sequence; identical to SEQ ID NO: 1784
  Synthetic

SEQ ID NO: 1957 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1958 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIEYFGRPYEGIAVFDGKKITVTGTLWNGNKIIDERLITPDGSMLFRVTINP

SEQ ID NO: 1959 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcttctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1960 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIFYFGRPYEGIAVFDGKKITVTGTLWNGNKIIDERLITPDGSMLFRVTINP

SEQ ID NO: 1961 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcggctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1962 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIGYFGRPYEGIAVFDGKKITVTGTLWNGNKIIDERLITPDGSMLFRVTINP

SEQ ID NO: 1963 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1964 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIHYFGRPYEGIAVFDGKKITVTGTLWNGNKIIDERLITPDGSMLFRVTINP

SEQ ID NO: 1965 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1966 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIIYFGRPYEGIAVFDGKKITVTGTLWNGNKIIDERLITPDGSMLFRVTINP

SEQ ID NO: 1967 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1968 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIKYFGRPYEGIAVFDGKKITVTGTLWNGNKIIDERLITPDGSMLFRVTINP

SEQ ID NO: 1969 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcctgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1970 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMILYFGRPYEGIAVFDGKKITVTGTLWNGNKIIDERLITPDGSMLFRVTINP

SEQ ID NO: 1971 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1972 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIMYFGRPYEGIAVFDGKKITVTGTLWNGNKIIDERLITPDGSMLFRVTINP

SEQ ID NO: 1973 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcccctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1974 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIPYFGRPYEGIAVFDGKKITVTGTLWNGNKIIDERLITPDGSMLFRVTINP

SEQ ID NO: 1975 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1976 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIQYFGRPYEGIAVFDGKKITVTGTLWNGNKIIDERLITPDGSMLFRVTINP

SEQ ID NO: 1977 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1978 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIRYFGRPYEGIAVFDGKKITVTGTLWNGNKIIDERLITPDGSMLFRVTINP

SEQ ID NO: 1979 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcagctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1980 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMISYFGRPYEGIAVFDGKKITVTGTLWNGNKIIDERLITPDGSMLFRVTINP

SEQ ID NO: 1981 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcacctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1982 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMITYFGRPYEGIAVFDGKKITVTGTLWNGNKIIDERLITPDGSMLFRVTINP

SEQ ID NO: 1983 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgtgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1984 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIVYFGRPYEGIAVFDGKKITVTGTLWNGNKIIDERLITPDGSMLFRVTINP

SEQ ID NO: 1985 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1986 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIWYFGRPYEGIAVFDGKKITVTGTLWNGNKIIDERLITPDGSMLFRVTINP

SEQ ID NO: 1987 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1988 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIYYFGRPYEGIAVFDGKKITVTGTLWNGNKIIDERLITPDGSMLFRVTINP

SEQ ID NO: 1989 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgcccccgacggctccatgctgttccgagtaaccatcaacccc

SEQ ID NO: 1990 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIAPDGSMLFRVTINP

SEQ ID NO: 1991 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctgccccgacggctccatgctgttccgagtaaccatcaacccc

SEQ ID NO: 1992 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLICPDGSMLFRVTINP

SEQ ID NO: 1993 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgaccccgacggctccatgctgttccgagtaaccatcaacccc

SEQ ID NO: 1994 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIDPDGSMLFRVTINP

SEQ ID NO: 1995 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgagcccgacggctccatgctgttccgagtaaccatcaacccc

SEQ ID NO: 1996 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIEPDGSMLFRVTINP

SEQ ID NO: 1997 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcttccccgacggctccatgctgttccgagtaaccatcaacccc

SEQ ID NO: 1998 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIFPDGSMLFRVTINP

SEQ ID NO: 1999 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcggccccgacggctccatgctgttccgagtaaccatcaacccc

SEQ ID NO: 2000 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIGPDGSMLFRVTINP

SEQ ID NO: 2001 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccaccccgacggctccatgctgttccgagtaaccatcaacccc

SEQ ID NO: 2002 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIHPDGSMLFRVTINP

SEQ ID NO: 2003 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatccccgacggctccatgctgttccgagtaaccatcaacccc

SEQ ID NO: 2004 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIIPDGSMLFRVTINP

SEQ ID NO: 2005 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaagcccgacggctccatgctgttccgagtaaccatcaacccc

SEQ ID NO: 2006 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIKPDGSMLFRVTINP

SEQ ID NO: 2007 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcctgcccgacggctccatgctgttccgagtaaccatcaacccc

SEQ ID NO: 2008 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLILPDGSMLFRVTINP

SEQ ID NO: 2009 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatgcccgacggctccatgctgttccgagtaaccatcaacccc

SEQ ID NO: 2010 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIMPDGSMLFRVTINP

SEQ ID NO: 2011 - DNA, 474 bp, Artificial Sequence; identical to SEQ ID NO: 1781
  Synthetic

SEQ ID NO: 2012 - protein, 158 aa, Artificial Sequence; identical to SEQ ID NO: 1782
  Synthetic

SEQ ID NO: 2013 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcccccccgacggctccatgctgttccgagtaaccatcaacccc

SEQ ID NO: 2014 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIPPDGSMLFRVTINP

SEQ ID NO: 2015 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccagcccgacggctccatgctgttccgagtaaccatcaacccc

SEQ ID NO: 2016 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIQPDGSMLFRVTINP

SEQ ID NO: 2017 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccggcccgacggctccatgctgttccgagtaaccatcaacccc

SEQ ID NO: 2018 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIRPDGSMLFRVTINP

SEQ ID NO: 2019 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcagccccgacggctccatgctgttccgagtaaccatcaacccc

SEQ ID NO: 2020 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLISPDGSMLFRVTINP

SEQ ID NO: 2021 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgtgcccgacggctccatgctgttccgagtaaccatcaacccc

SEQ ID NO: 2022 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIVPDGSMLFRVTINP

SEQ ID NO: 2023 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctggcccgacggctccatgctgttccgagtaaccatcaacccc

SEQ ID NO: 2024 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIWPDGSMLFRVTINP

SEQ ID NO: 2025 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctaccccgacggctccatgctgttccgagtaaccatcaacccc

SEQ ID NO: 2026 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIYPDGSMLFRVTINP

SEQ ID NO: 2027 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgcc

SEQ ID NO: 2028 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINA

SEQ ID NO: 2029 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgc

SEQ ID NO: 2030 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINC

SEQ ID NO: 2031 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgac

SEQ ID NO: 2032 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIND

SEQ ID NO: 2033 - DNA, 474 bp, Artificial Sequence; identical to SEQ ID NO: 1795
  Synthetic

SEQ ID NO: 2034 - protein, 158 aa, Artificial Sequence; identical to SEQ ID NO: 1796
  Synthetic

SEQ ID NO: 2035 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacttc

SEQ ID NO: 2036 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINF

SEQ ID NO: 2037 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggc

SEQ ID NO: 2038 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTING

SEQ ID NO: 2039 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 2040 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 2041 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatc

SEQ ID NO: 2042 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINI

SEQ ID NO: 2043 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaag

SEQ ID NO: 2044 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINK

SEQ ID NO: 2045 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacctg

SEQ ID NO: 2046 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINL

SEQ ID NO: 2047 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatg

SEQ ID NO: 2048 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINM

SEQ ID NO: 2049 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaac

SEQ ID NO: 2050 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINN

SEQ ID NO: 2051 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccag

SEQ ID NO: 2052 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINQ

SEQ ID NO: 2053 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccgg

SEQ ID NO: 2054 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINR

SEQ ID NO: 2055 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2056 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 2057 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacacc

SEQ ID NO: 2058 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINT

SEQ ID NO: 2059 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgtg

SEQ ID NO: 2060 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINV

SEQ ID NO: 2061 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgg

SEQ ID NO: 2062 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINW

SEQ ID NO: 2063 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactac

SEQ ID NO: 2064 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINY

SEQ ID NO: 2065 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2066 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMLNYFGRPYEGIAVFDGKKITVTGTLWNGNKIIDERLITPDGSMLFRVTINP

SEQ ID NO: 2067 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2068 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEEIFKVVYPVDDHHFKVILHYGTLVIDGVTPNMINYFGRPYEGIAVFDGKKITVTGTLWNGNKIIDERLITPDGSMLFRVTINP

SEQ ID NO: 2069 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcgacccc

SEQ ID NO: 2070 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTIDP

SEQ ID NO: 2071 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2072 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKVFKVVYPVDDHHFKVILHYGTLVIDGVTPNMINYFGRPYEGIAVFDGKKITVTGTLWNGNKIIDERLITPDGSMLFRVTINP

SEQ ID NO: 2073 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcatgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2074 - protein, 158 aa, Artificial Sequence
  Synthetic
VFTLEDFVGDWEQTAAYNLDQVLEQGGVSSLFQNLAVSVTPIQRIVLSDENALKIDIRVIIPYEGLSADQMAQIEKIFKVVYPVDDHHFKVIMHYGTLVVDGVTPNMINYFGRPYEGIAVFDGKKITVTGTLWNGNKIIDERLITPDGSMLFRVTINP

SEQ ID NO: 2075 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2076 - protein, 158 aa, Artificial Sequence
  Synthetic
VFTLEDFVGDWEQTAAYNLDQVLEQGGVSSLLQNLAASVTPIQRIVLSGENALKIDIHVIIPYEGLSADQMAQIEKIFKVVYPVDDHHFKVILHYGTLVVDGVTPNMINYFGRPYEGIAVFDGKKITVTGTLWNGNKIIDERLITPDGSMLFRVTINP

SEQ ID NO: 2077 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2078 - protein, 158 aa, Artificial Sequence
  Synthetic
VFTLEDFVGDWEQTAAYNLDQVLEQGGVSSLLQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2079 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggccatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2080 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKAILHYGTLVIDGVTPNMINYFGRPYEGIAVFDGKKITVTGTLWNGNKIIDERLITPDGSMLFRVTINP

SEQ ID NO: 2081 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaagggtggtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2082 - protein, 158 aa, Artificial Sequence
  Synthetic
VFTLEDFVGDWEQTAAYNLDQVLEQGGVSSLFQNLAVSVTPIQRVVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2083 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacgtgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2084 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDQHFKVILHYGTLVIDGVTPNVINYFGRPYEGIAVFDGKKITVTGTLWNGNKIIDERLITPDGSMLFRVTINP

SEQ ID NO: 2085 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcacctgatcacccccgacggctccatgctgttccgagtaaccatcaacccc

SEQ ID NO: 2086 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDEHLITPDGSMLFRVTINP

SEQ ID NO: 2087 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcaggacctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2088 - protein, 158 aa, Artificial Sequence
  Synthetic
VFTLEDFVGDWEQTAAYNLDQVLEQGGVSSLFQDLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2089 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggccacaaaattatcgacgagcgcctgatcacccccgacggctccatgctgttccgagtaaccatcaacccc

SEQ ID NO: 2090 - protein, 158 aa, Artificial Sequence
  Synthetic
VFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGHKIIDERLITPDGSMLFRVTINP

SEQ ID NO: 2091 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 2092 - protein, 158 aa, Artificial Sequence
  Synthetic
VFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 2093 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcgtgccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2094 - protein, 158 aa, Artificial Sequence
  Synthetic
VFTLEDFVGDWEQTAAYNLDQVLEQGGVSSLFQNLAVSVTPIQRIVLSGENALKIDIHVIVPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2095 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcaaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2096 - protein, 158 aa, Artificial Sequence
  Synthetic
VFTLEDFVGDWEQTAAYNLDQVLEQGGVSSLFQNLAVSVTPIQRIVLSGENTLKIDIHVIIPYEGLSADQMAQIKKIFKVVYPVDDHHFKVILHYGTLVIDGVTPNMINYFGRLYEGIAVFDGKKITVTGTLWNGNKIIDERLITPDGSMLFRVTINP

SEQ ID NO: 2097 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2098 - protein, 158 aa, Artificial Sequence
  Synthetic
VFTLEDFVGDWEQTAAYNLDQVLEQGGVSSLFQNLAASVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2099 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2100 - protein, 158 aa, Artificial Sequence
  Synthetic
VFTLEDFVGDWEQTAAYNLDQVLEQGGVSSLFQNLAVSVTPIQRIVLSGENTLKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2101 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2102 - protein, 158 aa, Artificial Sequence
  Synthetic
VFTLEDFVGDWEQTAAYNLDQVLEQGGVSSLFQNLAVSVTPIQRIVLSGENALKIDIRVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2103 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2104 - protein, 158 aa, Artificial Sequence
  Synthetic
VFTLEDFVGDWEQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2105 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcaagaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2106 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIKKIFKVVYPVDDHHFKVILHYGTLVIDGVTPNMINYFGRPYEGIAVFDGKKITVTGTLWNGNKIIDERLITPDGSMLFRVTINP

SEQ ID NO: 2107 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2108 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDQHFKVILHYGTLVIDGVTPNMINYFGRPYEGIAVFDGKKITVTGTLWNGNKIIDERLITPDGSMLFRVTINP

SEQ ID NO: 2109 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2110 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2111 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcaacccc

SEQ ID NO: 2112 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTINP

SEQ ID NO: 2113 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaagcgggaccctgtggaacggcaacaaaattatcgacgagcgcctgatcacccccgacggctccatgctgttccgagtaaccatcaacccc

SEQ ID NO: 2114 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVSGTLWNGNKIIDERLITPDGSMLFRVTINP

SEQ ID NO: 2115 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgccagatcacccccgacggctccatgctgttccgagtaaacatcaacccc

SEQ ID NO: 2116 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERQITPDGSMLFRVNINP

SEQ ID NO: 2117 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcgacccc

SEQ ID NO: 2118 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIDP

SEQ ID NO: 2119 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccaggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2120 - protein, 158 aa, Artificial Sequence
  Synthetic
VFTLEDFVGDWEQTAAYNLDQVLEQGGVSSLFQNLAVSVTPIQRIVLSGENALKIDIQVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2121 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcatgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2122 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVIMHYGTLVIDGVTPNMINYFGRPYEGIAVFDGKKITVTGTLWNGNKIIDERLITPDGSMLFRVTINP

SEQ ID NO: 2123 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2124 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRLYEGIAVFDGKKITVTGTLWNGNKIIDERLITPDGSMLFRVTINP

SEQ ID NO: 2125 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2126 - protein, 158 aa, Artificial Sequence
  Synthetic
VFTLEDFVGDWEQTAAYNLDQVLEQGGVSSLFQNLAVSVTPIQRIVLSDENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2127 - DNA, 441 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgac

SEQ ID NO: 2128 - protein, 147 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPD

SEQ ID NO: 2129 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2130 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 2131 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 2132 - protein, 158 aa, Artificial Sequence
  Synthetic
VFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 2133 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2134 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2135 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2136 - protein, 158 aa, Artificial Sequence
  Synthetic
VFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2137 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2138 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINP

SEQ ID NO: 2139 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2140 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINP

SEQ ID NO: 2141 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2142 - protein, 158 aa, Artificial Sequence
  Synthetic
VFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINS

SEQ ID NO: 2143 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2144 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINS

SEQ ID NO: 2145 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2146 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINS

SEQ ID NO: 2147 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2148 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 2149 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2150 - protein, 158 aa, Artificial Sequence
  Synthetic
VFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 2151 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2152 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEKVFKVVYPVDDHHFKVILPYGTLVIDGVTPNMLNYFGRPYEGIAVFDGKKITVTGTLWNGNKIIDERLITPDGSMLFRVTINS

SEQ ID NO: 2153 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2154 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEEIFKVVYPVDDHHFKVILPYGTLVIDGVTPNMLNYFGRPYEGIAVFDGKKITVTGTLWNGNKIIDERLITPDGSMLFRVTINS

SEQ ID NO: 2155 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2156 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMINYFGRPYEGIAVFDGKKITVTGTLWNGNKIIDERLITPDGSMLFRVTINS

SEQ ID NO: 2157 - protein, 171 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 2158 - DNA, 939 bp, Artificial Sequence
  Synthetic
ctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggttaa

SEQ ID NO: 2159 - protein, 312 aa, Artificial Sequence
  Synthetic
LEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 2160 - DNA, 939 bp, Artificial Sequence
  Synthetic
atggcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctcgagatttccggcgagccaaccactgaggatctgtactttcagagcgataacgcgatcgcc

SEQ ID NO: 2161 - protein, 313 aa, Artificial Sequence
  Synthetic
MAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGEPTTEDLYFQSDNAIA

SEQ ID NO: 2162 - DNA, 36 bp, Artificial Sequence
  Synthetic
atggtgaccggctaccggctgttcgaggagatcagc

SEQ ID NO: 2163 - protein, 12 aa, Artificial Sequence
  Synthetic
MVTGYRLFEEIS

SEQ ID NO: 2164 - DNA, 36 bp, Artificial Sequence
  Synthetic
atggtgaccggctaccggctgttcgaggaggccagc

SEQ ID NO: 2165 - protein, 12 aa, Artificial Sequence
  Synthetic
MVTGYRLFEEAS

SEQ ID NO: 2166 - DNA, 36 bp, Artificial Sequence
  Synthetic
atggtgaccggctaccggctgttcgaggaggagagc

SEQ ID NO: 2167 - protein, 12 aa, Artificial Sequence
  Synthetic
MVTGYRLFEEES

SEQ ID NO: 2168 - DNA, 36 bp, Artificial Sequence
  Synthetic
atggtgaccggctaccggctgttcgaggagatcctg

SEQ ID NO: 2169 - protein, 12 aa, Artificial Sequence
  Synthetic
MVTGYRLFEEIL

SEQ ID NO: 2170 - DNA, 36 bp, Artificial Sequence
  Synthetic
atggtgaccggctaccggctgttcgaggaggccctg

SEQ ID NO: 2171 - protein, 12 aa, Artificial Sequence
  Synthetic
MVTGYRLFEEAL

SEQ ID NO: 2172 - DNA, 36 bp, Artificial Sequence
  Synthetic
atggtgaccggctaccggctgttcgaggaggagctg

SEQ ID NO: 2173 - protein, 12 aa, Artificial Sequence
  Synthetic
MVTGYRLFEEEL

SEQ ID NO: 2174 - DNA, 36 bp, Artificial Sequence
  Synthetic
atggtggagggctaccggctgttcgaggagatcagc

SEQ ID NO: 2175 - protein, 12 aa, Artificial Sequence
  Synthetic
MVEGYRLFEEIS

SEQ ID NO: 2176 - DNA, 36 bp, Artificial Sequence
  Synthetic
atggtggagggctaccggctgttcgaggaggccagc

SEQ ID NO: 2177 - protein, 12 aa, Artificial Sequence
  Synthetic
MVEGYRLFEEAS

SEQ ID NO: 2178 - DNA, 36 bp, Artificial Sequence
  Synthetic
atggtggagggctaccggctgttcgaggaggagagc

SEQ ID NO: 2179 - protein, 12 aa, Artificial Sequence
  Synthetic
MVEGYRLFEEES

SEQ ID NO: 2180 - DNA, 36 bp, Artificial Sequence
  Synthetic
atggtggagggctaccggctgttcgaggagatcctg

SEQ ID NO: 2181 - protein, 12 aa, Artificial Sequence
  Synthetic
MVEGYRLFEEIL

SEQ ID NO: 2182 - DNA, 36 bp, Artificial Sequence
  Synthetic
atggtggagggctaccggctgttcgaggaggccctg

SEQ ID NO: 2183 - protein, 12 aa, Artificial Sequence
  Synthetic
MVEGYRLFEEAL

SEQ ID NO: 2184 - DNA, 36 bp, Artificial Sequence
  Synthetic
atggtggagggctaccggctgttcgaggaggagctg

SEQ ID NO: 2185 - protein, 12 aa, Artificial Sequence
  Synthetic
MVEGYRLFEEEL

SEQ ID NO: 2186 - DNA, 36 bp, Artificial Sequence
  Synthetic
atggtgaccggctaccggctgttcaagaagatcctg

SEQ ID NO: 2187 - protein, 12 aa, Artificial Sequence
  Synthetic
MVTGYRLFKKIL

SEQ ID NO: 2188 - DNA, 36 bp, Artificial Sequence
  Synthetic
atggtgaccggctaccggctgatgaagaagatcctg

SEQ ID NO: 2189 - protein, 12 aa, Artificial Sequence
  Synthetic
MVTGYRLMKKIL

SEQ ID NO: 2190 - DNA, 36 bp, Artificial Sequence
  Synthetic
atggtgaccggctaccggctgcacaagaagatcctg

SEQ ID NO: 2191 - protein, 12 aa, Artificial Sequence
  Synthetic
MVTGYRLHKKIL

SEQ ID NO: 2192 - DNA, 36 bp, Artificial Sequence
  Synthetic
atggtgaccggctaccggctgctgaagaagatcctg

SEQ ID NO: 2193 - protein, 12 aa, Artificial Sequence
  Synthetic
MVTGYRLLKKIL

SEQ ID NO: 2194 - DNA, 36 bp, Artificial Sequence
  Synthetic
atggtgaccggctaccggctgagcaagaagatcctg

SEQ ID NO: 2195 - protein, 12 aa, Artificial Sequence
  Synthetic
MVTGYRLSKKIL

SEQ ID NO: 2196 - DNA, 36 bp, Artificial Sequence
  Synthetic
atggtgaccggctaccggctgttcgagaagatcctg

SEQ ID NO: 2197 - protein, 12 aa, Artificial Sequence
  Synthetic
MVTGYRLFEKIL

SEQ ID NO: 2198 - DNA, 36 bp, Artificial Sequence
  Synthetic
atggtgaccggctaccggctgatggagaagatcctg

SEQ ID NO: 2199 - protein, 12 aa, Artificial Sequence
  Synthetic
MVTGYRLMEKIL

SEQ ID NO: 2200 - DNA, 36 bp, Artificial Sequence
  Synthetic
atggtgaccggctaccggctgcacgagaagatcctg

SEQ ID NO: 2201 - protein, 12 aa, Artificial Sequence
  Synthetic
MVTGYRLHEKIL

SEQ ID NO: 2202 - DNA, 36 bp, Artificial Sequence
  Synthetic
atggtgaccggctaccggctgctggagaagatcctg

SEQ ID NO: 2203 - protein, 12 aa, Artificial Sequence
  Synthetic
MVTGYRLLEKIL

SEQ ID NO: 2204 - DNA, 36 bp, Artificial Sequence
  Synthetic
atggtgaccggctaccggctgagcgagaagatcctg

SEQ ID NO: 2205 - protein, 12 aa, Artificial Sequence
  Synthetic
MVTGYRLSEKIL

SEQ ID NO: 2206 - DNA, 36 bp, Artificial Sequence
  Synthetic
atggtgaccggctaccggctgatggaggagatcctg

SEQ ID NO: 2207 - protein, 12 aa, Artificial Sequence
  Synthetic
MVTGYRLMEEIL

SEQ ID NO: 2208 - DNA, 36 bp, Artificial Sequence
  Synthetic
atggtgaccggctaccggctgcacgaggagatcctg

SEQ ID NO: 2209 - protein, 12 aa, Artificial Sequence
  Synthetic
MVTGYRLHEEIL

SEQ ID NO: 2210 - DNA, 36 bp, Artificial Sequence
  Synthetic
atggtgaccggctaccggctgctggaggagatcctg

SEQ ID NO: 2211 - protein, 12 aa, Artificial Sequence
  Synthetic
MVTGYRLLEEIL

SEQ ID NO: 2212 - DNA, 36 bp, Artificial Sequence
  Synthetic
atggtgaccggctaccggctgagcgaggagatcctg

SEQ ID NO: 2213 - protein, 12 aa, Artificial Sequence
  Synthetic
MVTGYRLSEEIL

SEQ ID NO: 2214 - DNA, 36 bp, Artificial Sequence
  Synthetic
atggtgagcggctaccggctgttcgaggagatcctg

SEQ ID NO: 2215 - protein, 12 aa, Artificial Sequence
  Synthetic
MVSGYRLFEEIL

SEQ ID NO: 2216 - DNA, 36 bp, Artificial Sequence
  Synthetic
atggtgaccggctggcggctgttcgaggagatcctg

SEQ ID NO: 2217 - protein, 12 aa, Artificial Sequence
  Synthetic
MVTGWRLFEEIL

SEQ ID NO: 2218 - DNA, 36 bp, Artificial Sequence
  Synthetic
atggtgagcggctggcggctgttcgaggagatcctg

SEQ ID NO: 2219 - protein, 12 aa, Artificial Sequence
  Synthetic
MVSGWRLFEEIL

SEQ ID NO: 2220 - DNA, 39 bp, Artificial Sequence
  Synthetic
atgaacgtgaccggctaccggctgttcgaggagatcctg

SEQ ID NO: 2221 - protein, 13 aa, Artificial Sequence
  Synthetic
MNVTGYRLFEEIL

SEQ ID NO: 2222 - DNA, 39 bp, Artificial Sequence
  Synthetic
atggtgaccggctaccggctgttcgaggagatcctgaac

SEQ ID NO: 2223 - protein, 13 aa, Artificial Sequence
  Synthetic
MVTGYRLFEEILN

SEQ ID NO: 2224 - DNA, 42 bp, Artificial Sequence
  Synthetic
atgaacgtgaccggctaccggctgttcgaggagatcctgaac

SEQ ID NO: 2225 - protein, 14 aa, Artificial Sequence
  Synthetic
MNVTGYRLFEEILN

SEQ ID NO: 2226 - DNA, 33 bp, Artificial Sequence
  Synthetic
atggtgaccggctaccggctgttcgaggagatc

SEQ ID NO: 2227 - protein, 11 aa, Artificial Sequence
  Synthetic
MVTGYRLFEEI

SEQ ID NO: 2228 - DNA, 36 bp, Artificial Sequence
  Synthetic
atggtgaccggctaccggctgttccagaagatcagc

SEQ ID NO: 2229 - protein, 12 aa, Artificial Sequence
  Synthetic
MVTGYRLFQKIS

SEQ ID NO: 2230 - DNA, 39 bp, Artificial Sequence
  Synthetic
atggtgaccggctaccggctgttcaagaagatcagcaac

SEQ ID NO: 2231 - protein, 13 aa, Artificial Sequence
  Synthetic
MVTGYRLFKKISN

SEQ ID NO: 2232 - DNA, 36 bp, Artificial Sequence
  Synthetic
atggtgaccggctaccggctgttcaagaagatcagc

SEQ ID NO: 2233 - protein, 12 aa, Artificial Sequence
  Synthetic
MVTGYRLFKKIS

SEQ ID NO: 2234 - protein, 13 aa, Artificial Sequence
  Synthetic
MVSGWRLFKKISA

SEQ ID NO: 2235 - protein, 13 aa, Artificial Sequence
  Synthetic
MGVSGWRLFKKIS

SEQ ID NO: 2236 - protein, 14 aa, Artificial Sequence
  Synthetic
MSVSGWRLFKKISN

SEQ ID NO: 2237 - protein, 14 aa, Artificial Sequence
  Synthetic
MSVSGWRLFKKISA

SEQ ID NO: 2238 - protein, 15 aa, Artificial Sequence
  Synthetic
MNSVSGWRLFKKISA

SEQ ID NO: 2239 - protein, 15 aa, Artificial Sequence
  Synthetic
MNSVSGWRLFKKISN

SEQ ID NO: 2240 - protein, 14 aa, Artificial Sequence
  Synthetic
MSNVSGWRLFKKIS

SEQ ID NO: 2241 - protein, 14 aa, Artificial Sequence
  Synthetic
MSGVSGWRLFKKIS

SEQ ID NO: 2242 - protein, 15 aa, Artificial Sequence
  Synthetic
MNSNVSGWRLFKKIS

SEQ ID NO: 2243 - protein, 15 aa, Artificial Sequence
  Synthetic
MNSGVSGWRLFKKIS

SEQ ID NO: 2244 - protein, 13 aa, Artificial Sequence
  Synthetic
MSVSGWRLFKKIS

SEQ ID NO: 2245 - protein, 14 aa, Artificial Sequence
  Synthetic
MNSVSGWRLFKKIS

SEQ ID NO: 2246 - protein, 15 aa, Artificial Sequence
  Synthetic
MSNVSGWRLFKKISN

SEQ ID NO: 2247 - protein, 16 aa, Artificial Sequence
  Synthetic
MNSNVSGWRLFKKISN

SEQ ID NO: 2248 - protein, 8 aa, Artificial Sequence
  Synthetic
MGWRLFKK

SEQ ID NO: 2249 - protein, 8 aa, Artificial Sequence
  Synthetic
MGWALFKK

SEQ ID NO: 2250 - protein, 12 aa, Artificial Sequence
  Synthetic
MVTGWALFEEIL

SEQ ID NO: 2251 - protein, 12 aa, Artificial Sequence
  Synthetic
MVTGYALFQEIL

SEQ ID NO: 2252 - protein, 12 aa, Artificial Sequence
  Synthetic
MVTGYALFEQIL

SEQ ID NO: 2253 - protein, 12 aa, Artificial Sequence
  Synthetic
MVTGYALFEEIL

SEQ ID NO: 2254 - DNA, 36 bp, Artificial Sequence
  Synthetic
atggtgtccggctgggcactgttcaagaaaatttcc

SEQ ID NO: 2255 - protein, 12 aa, Artificial Sequence
  Synthetic
MVSGWALFKKIS

SEQ ID NO: 2256 - protein, 12 aa, Artificial Sequence
  Synthetic
MVSGWKLFKKIS

SEQ ID NO: 2257 - DNA, 36 bp, Artificial Sequence
  Synthetic
atggtgtccggctggcagctgttcaagaaaatttcc

SEQ ID NO: 2258 - protein, 12 aa, Artificial Sequence
  Synthetic
MVSGWQLFKKIS

SEQ ID NO: 2259 - protein, 12 aa, Artificial Sequence
  Synthetic
MVSGWELFKKIS

SEQ ID NO: 2260 - DNA, 36 bp, Artificial Sequence
  Synthetic
atggtgtccggctggctgctgttcaagaaaatttcc

SEQ ID NO: 2261 - protein, 12 aa, Artificial Sequence
  Synthetic
MVSGWLLFKKIS

SEQ ID NO: 2262 - DNA, 36 bp, Artificial Sequence
  Synthetic
atggtgtccggctgggtgctgttcaagaaaatttcc

SEQ ID NO: 2263 - protein, 12 aa, Artificial Sequence
  Synthetic
MVSGWVLFKKIS

SEQ ID NO: 2264 - DNA, 33 bp, Artificial Sequence
  Synthetic
gtgaccggctaccggctgttcgaggagatcagc

SEQ ID NO: 2265 - protein, 11 aa, Artificial Sequence
  Synthetic
VTGYRLFEEIS

SEQ ID NO: 2266 - DNA, 33 bp, Artificial Sequence
  Synthetic
gtgaccggctaccggctgttcgaggaggccagc

SEQ ID NO: 2267 - protein, 11 aa, Artificial Sequence
  Synthetic
VTGYRLFEEAS

SEQ ID NO: 2268 - DNA, 33 bp, Artificial Sequence
  Synthetic
gtgaccggctaccggctgttcgaggaggagagc

SEQ ID NO: 2269 - protein, 11 aa, Artificial Sequence
  Synthetic
VTGYRLFEEES

SEQ ID NO: 2270 - DNA, 33 bp, Artificial Sequence
  Synthetic
gtgaccggctaccggctgttcgaggagatcctg

SEQ ID NO: 2271 - protein, 11 aa, Artificial Sequence
  Synthetic
VTGYRLFEEIL

SEQ ID NO: 2272 - DNA, 33 bp, Artificial Sequence
  Synthetic
gtgaccggctaccggctgttcgaggaggccctg

SEQ ID NO: 2273 - protein, 11 aa, Artificial Sequence
  Synthetic
VTGYRLFEEAL

SEQ ID NO: 2274 - DNA, 33 bp, Artificial Sequence
  Synthetic
gtgaccggctaccggctgttcgaggaggagctg

SEQ ID NO: 2275 - protein, 11 aa, Artificial Sequence
  Synthetic
VTGYRLFEEEL

SEQ ID NO: 2276 - DNA, 33 bp, Artificial Sequence
  Synthetic
gtggagggctaccggctgttcgaggagatcagc

SEQ ID NO: 2277 - protein, 11 aa, Artificial Sequence
  Synthetic
VEGYRLFEEIS

SEQ ID NO: 2278 - DNA, 33 bp, Artificial Sequence
  Synthetic
gtggagggctaccggctgttcgaggaggccagc

SEQ ID NO: 2279 - protein, 11 aa, Artificial Sequence
  Synthetic
VEGYRLFEEAS

SEQ ID NO: 2280 - DNA, 33 bp, Artificial Sequence
  Synthetic
gtggagggctaccggctgttcgaggaggagagc

SEQ ID NO: 2281 - protein, 11 aa, Artificial Sequence
  Synthetic
VEGYRLFEEES

SEQ ID NO: 2282 - DNA, 33 bp, Artificial Sequence
  Synthetic
gtggagggctaccggctgttcgaggagatcctg

SEQ ID NO: 2283 - protein, 11 aa, Artificial Sequence
  Synthetic
VEGYRLFEEIL

SEQ ID NO: 2284 - DNA, 33 bp, Artificial Sequence
  Synthetic
gtggagggctaccggctgttcgaggaggccctg

SEQ ID NO: 2285 - protein, 11 aa, Artificial Sequence
  Synthetic
VEGYRLFEEAL

SEQ ID NO: 2286 - DNA, 33 bp, Artificial Sequence
  Synthetic
gtggagggctaccggctgttcgaggaggagctg

SEQ ID NO: 2287 - protein, 11 aa, Artificial Sequence
  Synthetic
VEGYRLFEEEL

SEQ ID NO: 2288 - DNA, 33 bp, Artificial Sequence
  Synthetic
gtgaccggctaccggctgttcaagaagatcctg

SEQ ID NO: 2289 - protein, 11 aa, Artificial Sequence
  Synthetic
VTGYRLFKKIL

SEQ ID NO: 2290 - DNA, 33 bp, Artificial Sequence
  Synthetic
gtgaccggctaccggctgatgaagaagatcctg

SEQ ID NO: 2291 - protein, 11 aa, Artificial Sequence
  Synthetic
VTGYRLMKKIL

SEQ ID NO: 2292 - DNA, 33 bp, Artificial Sequence
  Synthetic
gtgaccggctaccggctgcacaagaagatcctg

SEQ ID NO: 2293 - protein, 11 aa, Artificial Sequence
  Synthetic
VTGYRLHKKIL

SEQ ID NO: 2294 - DNA, 33 bp, Artificial Sequence
  Synthetic
gtgaccggctaccggctgctgaagaagatcctg

SEQ ID NO: 2295 - protein, 11 aa, Artificial Sequence
  Synthetic
VTGYRLLKKIL

SEQ ID NO: 2296 - DNA, 33 bp, Artificial Sequence
  Synthetic
gtgaccggctaccggctgagcaagaagatcctg

SEQ ID NO: 2297 - protein, 11 aa, Artificial Sequence
  Synthetic
VTGYRLSKKIL

SEQ ID NO: 2298 - DNA, 33 bp, Artificial Sequence
  Synthetic
gtgaccggctaccggctgttcgagaagatcctg

SEQ ID NO: 2299 - protein, 11 aa, Artificial Sequence
  Synthetic
VTGYRLFEKIL

SEQ ID NO: 2300 - DNA, 33 bp, Artificial Sequence
  Synthetic
gtgaccggctaccggctgatggagaagatcctg

SEQ ID NO: 2301 - protein, 11 aa, Artificial Sequence
  Synthetic
VTGYRLMEKIL

SEQ ID NO: 2302 - DNA, 33 bp, Artificial Sequence
  Synthetic
gtgaccggctaccggctgcacgagaagatcctg

SEQ ID NO: 2303 - protein, 11 aa, Artificial Sequence
  Synthetic
VTGYRLHEKIL

SEQ ID NO: 2304 - DNA, 33 bp, Artificial Sequence
  Synthetic
gtgaccggctaccggctgctggagaagatcctg

SEQ ID NO: 2305 - protein, 11 aa, Artificial Sequence
  Synthetic
VTGYRLLEKIL

SEQ ID NO: 2306 - DNA, 33 bp, Artificial Sequence
  Synthetic
gtgaccggctaccggctgagcgagaagatcctg

SEQ ID NO: 2307 - protein, 11 aa, Artificial Sequence
  Synthetic
VTGYRLSEKIL

SEQ ID NO: 2308 - DNA, 33 bp, Artificial Sequence
  Synthetic
gtgaccggctaccggctgatggaggagatcctg

SEQ ID NO: 2309 - protein, 11 aa, Artificial Sequence
  Synthetic
VTGYRLMEEIL

SEQ ID NO: 2310 - DNA, 33 bp, Artificial Sequence
  Synthetic
gtgaccggctaccggctgcacgaggagatcctg

SEQ ID NO: 2311 - protein, 11 aa, Artificial Sequence
  Synthetic
VTGYRLHEEIL

SEQ ID NO: 2312 - DNA, 33 bp, Artificial Sequence
  Synthetic
gtgaccggctaccggctgctggaggagatcctg

SEQ ID NO: 2313 - protein, 11 aa, Artificial Sequence
  Synthetic
VTGYRLLEEIL

SEQ ID NO: 2314 - DNA, 33 bp, Artificial Sequence
  Synthetic
gtgaccggctaccggctgagcgaggagatcctg

SEQ ID NO: 2315 - protein, 11 aa, Artificial Sequence
  Synthetic
VTGYRLSEEIL

SEQ ID NO: 2316 - DNA, 33 bp, Artificial Sequence
  Synthetic
gtgagcggctaccggctgttcgaggagatcctg

SEQ ID NO: 2317 - protein, 11 aa, Artificial Sequence
  Synthetic
VSGYRLFEEIL

SEQ ID NO: 2318 - DNA, 33 bp, Artificial Sequence
  Synthetic
gtgaccggctggcggctgttcgaggagatcctg

SEQ ID NO: 2319 - protein, 11 aa, Artificial Sequence
  Synthetic
VTGWRLFEEIL

SEQ ID NO: 2320 - DNA, 33 bp, Artificial Sequence
  Synthetic
gtgagcggctggcggctgttcgaggagatcctg

SEQ ID NO: 2321 - protein, 11 aa, Artificial Sequence
  Synthetic
VSGWRLFEEIL

SEQ ID NO: 2322 - DNA, 36 bp, Artificial Sequence
  Synthetic
aacgtgaccggctaccggctgttcgaggagatcctg

SEQ ID NO: 2323 - protein, 12 aa, Artificial Sequence
  Synthetic
NVTGYRLFEEIL

SEQ ID NO: 2324 - DNA, 36 bp, Artificial Sequence
  Synthetic
gtgaccggctaccggctgttcgaggagatcctgaac

SEQ ID NO: 2325 - protein, 12 aa, Artificial Sequence
  Synthetic
VTGYRLFEEILN

SEQ ID NO: 2326 - DNA, 39 bp, Artificial Sequence
  Synthetic
aacgtgaccggctaccggctgttcgaggagatcctgaac

SEQ ID NO: 2327 - protein, 13 aa, Artificial Sequence
  Synthetic
NVTGYRLFEEILN

SEQ ID NO: 2328 - DNA, 30 bp, Artificial Sequence
  Synthetic
gtgaccggctaccggctgttcgaggagatc

SEQ ID NO: 2329 - protein, 10 aa, Artificial Sequence
  Synthetic
VTGYRLFEEI

SEQ ID NO: 2330 - DNA, 33 bp, Artificial Sequence
  Synthetic
gtgaccggctaccggctgttccagaagatcagc

SEQ ID NO: 2331 - protein, 11 aa, Artificial Sequence
  Synthetic
VTGYRLFQKIS

SEQ ID NO: 2332 - DNA, 36 bp, Artificial Sequence
  Synthetic
gtgaccggctaccggctgttcaagaagatcagcaac

SEQ ID NO: 2333 - protein, 12 aa, Artificial Sequence
  Synthetic
VTGYRLFKKISN

SEQ ID NO: 2334 - DNA, 33 bp, Artificial Sequence
  Synthetic
gtgaccggctaccggctgttcaagaagatcagc

SEQ ID NO: 2335 - protein, 11 aa, Artificial Sequence
  Synthetic
VTGYRLFKKIS

SEQ ID NO: 2336 - protein, 12 aa, Artificial Sequence
  Synthetic
VSGWRLFKKISA

SEQ ID NO: 2337 - protein, 12 aa, Artificial Sequence
  Synthetic
GVSGWRLFKKIS

SEQ ID NO: 2338 - protein, 13 aa, Artificial Sequence
  Synthetic
SVSGWRLFKKISN

SEQ ID NO: 2339 - protein, 13 aa, Artificial Sequence
  Synthetic
SVSGWRLFKKISA

SEQ ID NO: 2340 - protein, 14 aa, Artificial Sequence
  Synthetic
NSVSGWRLFKKISA

SEQ ID NO: 2341 - protein, 14 aa, Artificial Sequence
  Synthetic
NSVSGWRLFKKISN

SEQ ID NO: 2342 - protein, 13 aa, Artificial Sequence
  Synthetic
SNVSGWRLFKKIS

SEQ ID NO: 2343 - protein, 13 aa, Artificial Sequence
  Synthetic
SGVSGWRLFKKIS

SEQ ID NO: 2344 - protein, 14 aa, Artificial Sequence
  Synthetic
NSNVSGWRLFKKIS

SEQ ID NO: 2345 - protein, 14 aa, Artificial Sequence
  Synthetic
NSGVSGWRLFKKIS

SEQ ID NO: 2346 - protein, 12 aa, Artificial Sequence
  Synthetic
SVSGWRLFKKIS

SEQ ID NO: 2347 - protein, 13 aa, Artificial Sequence
  Synthetic
NSVSGWRLFKKIS

SEQ ID NO: 2348 - protein, 14 aa, Artificial Sequence
  Synthetic
SNVSGWRLFKKISN

SEQ ID NO: 2349 - protein, 15 aa, Artificial Sequence
  Synthetic
NSNVSGWRLFKKISN

SEQ ID NO: 2350 - protein, 7 aa, Artificial Sequence
  Synthetic
GWRLFKK

SEQ ID NO: 2351 - protein, 7 aa, Artificial Sequence
  Synthetic
GWALFKK

SEQ ID NO: 2352 - protein, 11 aa, Artificial Sequence
  Synthetic
VTGWALFEEIL

SEQ ID NO: 2353 - protein, 11 aa, Artificial Sequence
  Synthetic
VTGYALFQEIL

SEQ ID NO: 2354 - protein, 11 aa, Artificial Sequence
  Synthetic
VTGYALFEQIL

SEQ ID NO: 2355 - protein, 11 aa, Artificial Sequence
  Synthetic
VTGYALFEEIL

SEQ ID NO: 2356 - DNA, 33 bp, Artificial Sequence
  Synthetic
gtgtccggctgggcactgttcaagaaaatttcc

SEQ ID NO: 2357 - protein, 11 aa, Artificial Sequence
  Synthetic
VSGWALFKKIS

SEQ ID NO: 2358 - protein, 11 aa, Artificial Sequence
  Synthetic
VSGWKLFKKIS

SEQ ID NO: 2359 - DNA, 33 bp, Artificial Sequence
  Synthetic
gtgtccggctggcagctgttcaagaaaatttcc

SEQ ID NO: 2360 - protein, 11 aa, Artificial Sequence
  Synthetic
VSGWQLFKKIS

SEQ ID NO: 2361 - protein, 11 aa, Artificial Sequence
  Synthetic
VSGWELFKKIS

SEQ ID NO: 2362 - DNA, 33 bp, Artificial Sequence
  Synthetic
gtgtccggctggctgctgttcaagaaaatttcc

SEQ ID NO: 2363 - protein, 11 aa, Artificial Sequence
  Synthetic
VSGWLLFKKIS

SEQ ID NO: 2364 - DNA, 33 bp, Artificial Sequence
  Synthetic
gtgtccggctgggtgctgttcaagaaaatttcc

SEQ ID NO: 2365 - protein, 11 aa, Artificial Sequence
  Synthetic
VSGWVLFKKIS

SEQ ID NO: 2366 - protein, 11 aa, Artificial Sequence
  Synthetic
VTGWRLCERIL

SEQ ID NO: 2367 - protein, 11 aa, Artificial Sequence
  Synthetic
VSGWRLFKKIS

SEQ ID NO: 2368 - protein, 11 aa, Artificial Sequence
  Synthetic
VTGYRLFKKIS

SEQ ID NO: 2369 - protein, 11 aa, Artificial Sequence
  Synthetic
ISGWRLFKKIS

SEQ ID NO: 2370 - protein, 11 aa, Artificial Sequence
  Synthetic
ASGWRLFKKIS

SEQ ID NO: 2371 - protein, 11 aa, Artificial Sequence
  Synthetic
GSGWRLFKKIS

SEQ ID NO: 2372 - protein, 11 aa, Artificial Sequence
  Synthetic
KSGWRLFKKIS

SEQ ID NO: 2373 - protein, 11 aa, Artificial Sequence
  Synthetic
LSGWRLFKKIS

SEQ ID NO: 2374 - protein, 11 aa, Artificial Sequence
  Synthetic
QSGWRLFKKIS

SEQ ID NO: 2375 - protein, 11 aa, Artificial Sequence
  Synthetic
SSGWRLFKKIS

SEQ ID NO: 2376 - protein, 11 aa, Artificial Sequence
  Synthetic
TSGWRLFKKIS

SEQ ID NO: 2377 - protein, 11 aa, Artificial Sequence
  Synthetic
VVGWRLFKKIS

SEQ ID NO: 2378 - protein, 11 aa, Artificial Sequence
  Synthetic
VKGWRLFKKIS

SEQ ID NO: 2379 - protein, 11 aa, Artificial Sequence
  Synthetic
VIGWRLFKKIS

SEQ ID NO: 2380 - protein, 11 aa, Artificial Sequence
  Synthetic
VEGWRLFKKIS

SEQ ID NO: 2381 - protein, 11 aa, Artificial Sequence
  Synthetic
VAGWRLFKKIS

SEQ ID NO: 2382 - protein, 11 aa, Artificial Sequence
  Synthetic
VQGWRLFKKIS

SEQ ID NO: 2383 - protein, 11 aa, Artificial Sequence
  Synthetic
VHGWRLFKKIS

SEQ ID NO: 2384 - protein, 11 aa, Artificial Sequence
  Synthetic
VSAWRLFKKIS

SEQ ID NO: 2385 - protein, 11 aa, Artificial Sequence
  Synthetic
VSSWRLFKKIS

SEQ ID NO: 2386 - protein, 11 aa, Artificial Sequence
  Synthetic
VSGFRLFKKIS

SEQ ID NO: 2387 - protein, 11 aa, Artificial Sequence
  Synthetic
VSGWKLFKKIS

SEQ ID NO: 2388 - protein, 11 aa, Artificial Sequence
  Synthetic
VSGWQLFKKIS

SEQ ID NO: 2389 - protein, 11 aa, Artificial Sequence
  Synthetic
VSGWELFKKIS

SEQ ID NO: 2390 - protein, 11 aa, Artificial Sequence
  Synthetic
VSGWALFKKIS

SEQ ID NO: 2391 - protein, 11 aa, Artificial Sequence
  Synthetic
VSGWRIFKKIS

SEQ ID NO: 2392 - protein, 11 aa, Artificial Sequence
  Synthetic
VSGWRVFKKIS

SEQ ID NO: 2393 - protein, 11 aa, Artificial Sequence
  Synthetic
VSGWRTFKKIS

SEQ ID NO: 2394 - protein, 11 aa, Artificial Sequence
  Synthetic
VSGWRYFKKIS

SEQ ID NO: 2395 - protein, 11 aa, Artificial Sequence
  Synthetic
VSGWRKFKKIS

SEQ ID NO: 2396 - protein, 11 aa, Artificial Sequence
  Synthetic
VSGWRFFKKIS

SEQ ID NO: 2397 - protein, 11 aa, Artificial Sequence
  Synthetic
VSGWRLAKKIS

SEQ ID NO: 2398 - protein, 11 aa, Artificial Sequence
  Synthetic
VSGWRLDKKIS

SEQ ID NO: 2399 - protein, 11 aa, Artificial Sequence
  Synthetic
VSGWRLEKKIS

SEQ ID NO: 2400 - protein, 11 aa, Artificial Sequence
  Synthetic
VSGWRLGKKIS

SEQ ID NO: 2401 - protein, 11 aa, Artificial Sequence
  Synthetic
VSGWRLHKKIS

SEQ ID NO: 2402 - protein, 11 aa, Artificial Sequence
  Synthetic
VSGWRLIKKIS

SEQ ID NO: 2403 - protein, 11 aa, Artificial Sequence
  Synthetic
VSGWRLKKKIS

SEQ ID NO: 2404 - protein, 11 aa, Artificial Sequence
  Synthetic
VSGWRLLKKIS

SEQ ID NO: 2405 - protein, 11 aa, Artificial Sequence
  Synthetic
VSGWRLMKKIS

SEQ ID NO: 2406 - protein, 11 aa, Artificial Sequence
  Synthetic
VSGWRLNKKIS

SEQ ID NO: 2407 - protein, 11 aa, Artificial Sequence
  Synthetic
VSGWRLQKKIS

SEQ ID NO: 2408 - protein, 11 aa, Artificial Sequence
  Synthetic
VSGWRLRKKIS

SEQ ID NO: 2409 - protein, 11 aa, Artificial Sequence
  Synthetic
VSGWRLSKKIS

SEQ ID NO: 2410 - protein, 11 aa, Artificial Sequence
  Synthetic
VSGWRLTKKIS

SEQ ID NO: 2411 - protein, 11 aa, Artificial Sequence
  Synthetic
VSGWRLVKKIS

SEQ ID NO: 2412 - protein, 11 aa, Artificial Sequence
  Synthetic
VSGWRLWKKIS

SEQ ID NO: 2413 - protein, 11 aa, Artificial Sequence
  Synthetic
VSGWRLYKKIS

SEQ ID NO: 2414 - protein, 11 aa, Artificial Sequence
  Synthetic
VSGWRLFEKIS

SEQ ID NO: 2415 - protein, 11 aa, Artificial Sequence
  Synthetic
VSGWRLFVKIS

SEQ ID NO: 2416 - protein, 11 aa, Artificial Sequence
  Synthetic
VSGWRLFSKIS

SEQ ID NO: 2417 - protein, 11 aa, Artificial Sequence
  Synthetic
VSGWRLFRKIS

SEQ ID NO: 2418 - protein, 11 aa, Artificial Sequence
  Synthetic
VSGWRLFTKIS

SEQ ID NO: 2419 - protein, 11 aa, Artificial Sequence
  Synthetic
VSGWRLFNKIS

SEQ ID NO: 2420 - protein, 11 aa, Artificial Sequence
  Synthetic
VSGWRLFQKIS

SEQ ID NO: 2421 - protein, 11 aa, Artificial Sequence
  Synthetic
VSGWRLFKRIS

SEQ ID NO: 2422 - protein, 11 aa, Artificial Sequence
  Synthetic
VSGWRLFKQIS

SEQ ID NO: 2423 - protein, 11 aa, Artificial Sequence
  Synthetic
VSGWRLFKEIS

SEQ ID NO: 2424 - protein, 11 aa, Artificial Sequence
  Synthetic
VSGWRLFKAIS

SEQ ID NO: 2425 - protein, 11 aa, Artificial Sequence
  Synthetic
VSGWRLFKKVS

SEQ ID NO: 2426 - protein, 11 aa, Artificial Sequence
  Synthetic
VSGWRLFKKLS

SEQ ID NO: 2427 - protein, 11 aa, Artificial Sequence
  Synthetic
VSGWRLFKKAS

SEQ ID NO: 2428 - protein, 11 aa, Artificial Sequence
  Synthetic
VSGWRLFKKFS

SEQ ID NO: 2429 - protein, 11 aa, Artificial Sequence
  Synthetic
VSGWRLFKKES

SEQ ID NO: 2430 - protein, 11 aa, Artificial Sequence
  Synthetic
VSGWRLFKKTS

SEQ ID NO: 2431 - protein, 11 aa, Artificial Sequence
  Synthetic
VSGWRLFKKIL

SEQ ID NO: 2432 - protein, 11 aa, Artificial Sequence
  Synthetic
VSGWRLFKKIA

SEQ ID NO: 2433 - protein, 11 aa, Artificial Sequence
  Synthetic
VSGWRLFKKIE

SEQ ID NO: 2434 - protein, 11 aa, Artificial Sequence
  Synthetic
VSGWRLFKKIV

SEQ ID NO: 2435 - protein, 11 aa, Artificial Sequence
  Synthetic
VSGWRLFKKIG

SEQ ID NO: 2436 - protein, 11 aa, Artificial Sequence
  Synthetic
VSGWRLFKKIH

SEQ ID NO: 2437 - protein, 11 aa, Artificial Sequence
  Synthetic
VSGWRLFKKIT

SEQ ID NO: 2438 - protein, 11 aa, Artificial Sequence
  Synthetic
VVGYRLFKKIS

SEQ ID NO: 2439 - protein, 11 aa, Artificial Sequence
  Synthetic
VKGYRLFKKIS

SEQ ID NO: 2440 - protein, 11 aa, Artificial Sequence
  Synthetic
VIGYRLFKKIS

SEQ ID NO: 2441 - protein, 11 aa, Artificial Sequence
  Synthetic
VEGYRLFKKIS

SEQ ID NO: 2442 - protein, 11 aa, Artificial Sequence
  Synthetic
VAGYRLFKKIS

SEQ ID NO: 2443 - protein, 11 aa, Artificial Sequence
  Synthetic
VQGYRLFKKIS

SEQ ID NO: 2444 - protein, 11 aa, Artificial Sequence
  Synthetic
VHGYRLFKKIS

SEQ ID NO: 2445 - protein, 11 aa, Artificial Sequence
  Synthetic
VTAYRLFKKIS

SEQ ID NO: 2446 - protein, 11 aa, Artificial Sequence
  Synthetic
VTSYRLFKKIS

SEQ ID NO: 2447 - protein, 11 aa, Artificial Sequence
  Synthetic
VTGYRIFKKIS

SEQ ID NO: 2448 - protein, 11 aa, Artificial Sequence
  Synthetic
VTGYRVFKKIS

SEQ ID NO: 2449 - protein, 11 aa, Artificial Sequence
  Synthetic
VTGYRTFKKIS

SEQ ID NO: 2450 - protein, 11 aa, Artificial Sequence
  Synthetic
VTGYRYFKKIS

SEQ ID NO: 2451 - protein, 11 aa, Artificial Sequence
  Synthetic
VTGYRKFKKIS

SEQ ID NO: 2452 - protein, 11 aa, Artificial Sequence
  Synthetic
VTGYRFFKKIS

SEQ ID NO: 2453 - protein, 11 aa, Artificial Sequence
  Synthetic
ISGWRLMKNIS

SEQ ID NO: 2454 - protein, 11 aa, Artificial Sequence
  Synthetic
ASGWRLMKKES

SEQ ID NO: 2455 - protein, 11 aa, Artificial Sequence
  Synthetic
VSGWRLMKKVS

SEQ ID NO: 2456 - protein, 11 aa, Artificial Sequence
  Synthetic
ISGWRLLKNIS

SEQ ID NO: 2457 - protein, 11 aa, Artificial Sequence
  Synthetic
ASGWRLLKKES

SEQ ID NO: 2458 - protein, 11 aa, Artificial Sequence
  Synthetic
VSGWRLLKKVS

SEQ ID NO: 2459 - protein, 11 aa, Artificial Sequence
  Synthetic
ISGWRLAKNIS

SEQ ID NO: 2460 - protein, 11 aa, Artificial Sequence
  Synthetic
ASGWRLAKKES

SEQ ID NO: 2461 - protein, 11 aa, Artificial Sequence
  Synthetic
VSGWRLAKKVS

SEQ ID NO: 2462 - protein, 11 aa, Artificial Sequence
  Synthetic
VTGYRLFKKIS

SEQ ID NO: 2463 - protein, 11 aa, Artificial Sequence
  Synthetic
VTGYRLFKKAS

SEQ ID NO: 2464 - protein, 11 aa, Artificial Sequence
  Synthetic
VTGYRLFKKES

SEQ ID NO: 2465 - protein, 11 aa, Artificial Sequence
  Synthetic
VTGYRLFKQIS

SEQ ID NO: 2466 - protein, 11 aa, Artificial Sequence
  Synthetic
VTGYRLFKQAS

SEQ ID NO: 2467 - protein, 11 aa, Artificial Sequence
  Synthetic
VTGYRLFKQES

SEQ ID NO: 2468 - protein, 11 aa, Artificial Sequence
  Synthetic
VTGYRLFKEIS

SEQ ID NO: 2469 - protein, 11 aa, Artificial Sequence
  Synthetic
VTGYRLFKEAS

SEQ ID NO: 2470 - protein, 11 aa, Artificial Sequence
  Synthetic
VTGYRLFKEES

SEQ ID NO: 2471 - protein, 11 aa, Artificial Sequence
  Synthetic
VTGYRLFQKIS

SEQ ID NO: 2472 - protein, 11 aa, Artificial Sequence
  Synthetic
VTGYRLFQKAS

SEQ ID NO: 2473 - protein, 11 aa, Artificial Sequence
  Synthetic
VTGYRLFQKES

SEQ ID NO: 2474 - protein, 11 aa, Artificial Sequence
  Synthetic
VTGYRLFQQIS

SEQ ID NO: 2475 - protein, 11 aa, Artificial Sequence
  Synthetic
VTGYRLFQQAS

SEQ ID NO: 2476 - protein, 11 aa, Artificial Sequence
  Synthetic
VTGYRLFQQES

SEQ ID NO: 2477 - protein, 11 aa, Artificial Sequence
  Synthetic
VTGYRLFQEIS

SEQ ID NO: 2478 - protein, 11 aa, Artificial Sequence
  Synthetic
VTGYRLFQEAS

SEQ ID NO: 2479 - protein, 11 aa, Artificial Sequence
  Synthetic
VTGYRLFQEES

SEQ ID NO: 2480 - protein, 11 aa, Artificial Sequence
  Synthetic
VTGYRLFEKIS

SEQ ID NO: 2481 - protein, 11 aa, Artificial Sequence
  Synthetic
VTGYRLFEKAS

SEQ ID NO: 2482 - protein, 11 aa, Artificial Sequence
  Synthetic
VTGYRLFEKES

SEQ ID NO: 2483 - protein, 11 aa, Artificial Sequence
  Synthetic
VTGYRLFEQIS

SEQ ID NO: 2484 - protein, 11 aa, Artificial Sequence
  Synthetic
VTGYRLFEQAS

SEQ ID NO: 2485 - protein, 11 aa, Artificial Sequence
  Synthetic
VTGYRLFEQES

SEQ ID NO: 2486 - protein, 11 aa, Artificial Sequence
  Synthetic
VTGYRLFEEIS

SEQ ID NO: 2487 - protein, 11 aa, Artificial Sequence
  Synthetic
VTGYRLFEEAS

SEQ ID NO: 2488 - protein, 11 aa, Artificial Sequence
  Synthetic
VTGYRLFEEES

SEQ ID NO: 2489 - protein, 11 aa, Artificial Sequence
  Synthetic
VTGYRLFKKIL

SEQ ID NO: 2490 - protein, 11 aa, Artificial Sequence
  Synthetic
VTGYRLFKKAL

SEQ ID NO: 2491 - protein, 11 aa, Artificial Sequence
  Synthetic
VTGYRLFKKEL

SEQ ID NO: 2492 - protein, 11 aa, Artificial Sequence
  Synthetic
VTGYRLFKQIL

SEQ ID NO: 2493 - protein, 11 aa, Artificial Sequence
  Synthetic
VTGYRLFKQAL

SEQ ID NO: 2494 - protein, 11 aa, Artificial Sequence
  Synthetic
VTGYRLFKQEL

SEQ ID NO: 2495 - protein, 11 aa, Artificial Sequence
  Synthetic
VTGYRLFKEIL

SEQ ID NO: 2496 - protein, 11 aa, Artificial Sequence
  Synthetic
VTGYRLFKEAL

SEQ ID NO: 2497 - protein, 11 aa, Artificial Sequence
  Synthetic
VTGYRLFKEEL

SEQ ID NO: 2498 - protein, 11 aa, Artificial Sequence
  Synthetic
VTGYRLFQKIL

SEQ ID NO: 2499 - protein, 11 aa, Artificial Sequence
  Synthetic
VTGYRLFQKAL

SEQ ID NO: 2500 - protein, 11 aa, Artificial Sequence
  Synthetic
VTGYRLFQKEL

SEQ ID NO: 2501 - protein, 11 aa, Artificial Sequence
  Synthetic
VTGYRLFQQIL

SEQ ID NO: 2502 - protein, 11 aa, Artificial Sequence
  Synthetic
VTGYRLFQQAL

SEQ ID NO: 2503 - protein, 11 aa, Artificial Sequence
  Synthetic
VTGYRLFQQEL

SEQ ID NO: 2504 - protein, 11 aa, Artificial Sequence
  Synthetic
VTGYRLFQEIL

SEQ ID NO: 2505 - protein, 11 aa, Artificial Sequence
  Synthetic
VTGYRLFQEAL

SEQ ID NO: 2506 - protein, 11 aa, Artificial Sequence
  Synthetic
VTGYRLFQEEL

SEQ ID NO: 2507 - protein, 11 aa, Artificial Sequence
  Synthetic
VTGYRLFEKIL

SEQ ID NO: 2508 - protein, 11 aa, Artificial Sequence
  Synthetic
VTGYRLFEKAL

SEQ ID NO: 2509 - protein, 11 aa, Artificial Sequence
  Synthetic
VTGYRLFEKEL

SEQ ID NO: 2510 - protein, 11 aa, Artificial Sequence
  Synthetic
VTGYRLFEQIL

SEQ ID NO: 2511 - protein, 11 aa, Artificial Sequence
  Synthetic
VTGYRLFEQAL

SEQ ID NO: 2512 - protein, 11 aa, Artificial Sequence
  Synthetic
VTGYRLFEQEL

SEQ ID NO: 2513 - protein, 11 aa, Artificial Sequence
  Synthetic
VTGYRLFEEIL

SEQ ID NO: 2514 - protein, 11 aa, Artificial Sequence
  Synthetic
VTGYRLFEEAL

SEQ ID NO: 2515 - protein, 11 aa, Artificial Sequence
  Synthetic
VTGYRLFEEEL

SEQ ID NO: 2516 - protein, 11 aa, Artificial Sequence
  Synthetic
VEGYRLFKKIS

SEQ ID NO: 2517 - protein, 11 aa, Artificial Sequence
  Synthetic
VEGYRLFKKAS

SEQ ID NO: 2518 - protein, 11 aa, Artificial Sequence
  Synthetic
VEGYRLFKKES

SEQ ID NO: 2519 - protein, 11 aa, Artificial Sequence
  Synthetic
VEGYRLFKQIS

SEQ ID NO: 2520 - protein, 11 aa, Artificial Sequence
  Synthetic
VEGYRLFKQAS

SEQ ID NO: 2521 - protein, 11 aa, Artificial Sequence
  Synthetic
VEGYRLFKQES

SEQ ID NO: 2522 - protein, 11 aa, Artificial Sequence
  Synthetic
VEGYRLFKEIS

SEQ ID NO: 2523 - protein, 11 aa, Artificial Sequence
  Synthetic
VEGYRLFKEAS

SEQ ID NO: 2524 - protein, 11 aa, Artificial Sequence
  Synthetic
VEGYRLFKEES

SEQ ID NO: 2525 - protein, 11 aa, Artificial Sequence
  Synthetic
VEGYRLFQKIS

SEQ ID NO: 2526 - protein, 11 aa, Artificial Sequence
  Synthetic
VEGYRLFQKAS

SEQ ID NO: 2527 - protein, 11 aa, Artificial Sequence
  Synthetic
VEGYRLFQKES

SEQ ID NO: 2528 - protein, 11 aa, Artificial Sequence
  Synthetic
VEGYRLFQQIS

SEQ ID NO: 2529 - protein, 11 aa, Artificial Sequence
  Synthetic
VEGYRLFQQAS

SEQ ID NO: 2530 - protein, 11 aa, Artificial Sequence
  Synthetic
VEGYRLFQQES

SEQ ID NO: 2531 - protein, 11 aa, Artificial Sequence
  Synthetic
VEGYRLFQEIS

SEQ ID NO: 2532 - protein, 11 aa, Artificial Sequence
  Synthetic
VEGYRLFQEAS

SEQ ID NO: 2533 - protein, 11 aa, Artificial Sequence
  Synthetic
VEGYRLFQEES

SEQ ID NO: 2534 - protein, 11 aa, Artificial Sequence
  Synthetic
VEGYRLFEKIS

SEQ ID NO: 2535 - protein, 11 aa, Artificial Sequence
  Synthetic
VEGYRLFEKAS

SEQ ID NO: 2536 - protein, 11 aa, Artificial Sequence
  Synthetic
VEGYRLFEKES

SEQ ID NO: 2537 - protein, 11 aa, Artificial Sequence
  Synthetic
VEGYRLFEQIS

SEQ ID NO: 2538 - protein, 11 aa, Artificial Sequence
  Synthetic
VEGYRLFEQAS

SEQ ID NO: 2539 - protein, 11 aa, Artificial Sequence
  Synthetic
VEGYRLFEQES

SEQ ID NO: 2540 - protein, 11 aa, Artificial Sequence
  Synthetic
VEGYRLFEEIS

SEQ ID NO: 2541 - protein, 11 aa, Artificial Sequence
  Synthetic
VEGYRLFEEAS

SEQ ID NO: 2542 - protein, 11 aa, Artificial Sequence
  Synthetic
VEGYRLFEEES

SEQ ID NO: 2543 - protein, 11 aa, Artificial Sequence
  Synthetic
VEGYRLFKKIL

SEQ ID NO: 2544 - protein, 11 aa, Artificial Sequence
  Synthetic
VEGYRLFKKAL

SEQ ID NO: 2545 - protein, 11 aa, Artificial Sequence
  Synthetic
VEGYRLFKKEL

SEQ ID NO: 2546 - protein, 11 aa, Artificial Sequence
  Synthetic
VEGYRLFKQIL

SEQ ID NO: 2547 - protein, 11 aa, Artificial Sequence
  Synthetic
VEGYRLFKQAL

SEQ ID NO: 2548 - protein, 11 aa, Artificial Sequence
  Synthetic
VEGYRLFKQEL

SEQ ID NO: 2549 - protein, 11 aa, Artificial Sequence
  Synthetic
VEGYRLFKEIL

SEQ ID NO: 2550 - protein, 11 aa, Artificial Sequence
  Synthetic
VEGYRLFKEAL

SEQ ID NO: 2551 - protein, 11 aa, Artificial Sequence
  Synthetic
VEGYRLFKEEL

SEQ ID NO: 2552 - protein, 11 aa, Artificial Sequence
  Synthetic
VEGYRLFQKIL

SEQ ID NO: 2553 - protein, 11 aa, Artificial Sequence
  Synthetic
VEGYRLFQKAL

SEQ ID NO: 2554 - protein, 11 aa, Artificial Sequence
  Synthetic
VEGYRLFQKEL

SEQ ID NO: 2555 - protein, 11 aa, Artificial Sequence
  Synthetic
VEGYRLFQQIL

SEQ ID NO: 2556 - protein, 11 aa, Artificial Sequence
  Synthetic
VEGYRLFQQAL

SEQ ID NO: 2557 - protein, 11 aa, Artificial Sequence
  Synthetic
VEGYRLFQQEL

SEQ ID NO: 2558 - protein, 11 aa, Artificial Sequence
  Synthetic
VEGYRLFQEIL

SEQ ID NO: 2559 - protein, 11 aa, Artificial Sequence
  Synthetic
VEGYRLFQEAL

SEQ ID NO: 2560 - protein, 11 aa, Artificial Sequence
  Synthetic
VEGYRLFQEEL

SEQ ID NO: 2561 - protein, 11 aa, Artificial Sequence
  Synthetic
VEGYRLFEKIL

SEQ ID NO: 2562 - protein, 11 aa, Artificial Sequence
  Synthetic
VEGYRLFEKAL

SEQ ID NO: 2563 - protein, 11 aa, Artificial Sequence
  Synthetic
VEGYRLFEKEL

SEQ ID NO: 2564 - protein, 11 aa, Artificial Sequence
  Synthetic
VEGYRLFEQIL

SEQ ID NO: 2565 - protein, 11 aa, Artificial Sequence
  Synthetic
VEGYRLFEQAL

SEQ ID NO: 2566 - protein, 11 aa, Artificial Sequence
  Synthetic
VEGYRLFEQEL

SEQ ID NO: 2567 - protein, 11 aa, Artificial Sequence
  Synthetic
VEGYRLFEEIL

SEQ ID NO: 2568 - protein, 11 aa, Artificial Sequence
  Synthetic
VEGYRLFEEAL

SEQ ID NO: 2569 - protein, 11 aa, Artificial Sequence
  Synthetic
VEGYRLFEEEL

SEQ ID NO: 2570 - protein, 7 aa, Artificial Sequence
  Synthetic
GWRLFKK

SEQ ID NO: 2571 - protein, 7 aa, Artificial Sequence
  Synthetic
GWALFKK

SEQ ID NO: 2572 - protein, 11 aa, Artificial Sequence
  Synthetic
VTGWALFEEIL

SEQ ID NO: 2573 - protein, 11 aa, Artificial Sequence
  Synthetic
VTGYALFQEIL

SEQ ID NO: 2574 - protein, 11 aa, Artificial Sequence
  Synthetic
VTGYALFEQIL

SEQ ID NO: 2575 - protein, 11 aa, Artificial Sequence
  Synthetic
VTGYALFEEIL

SEQ ID NO: 2576 - DNA, 1143 bp, Artificial sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagtgggagctccggtggtggcgggagcggaggtggaggctcgagcggtgcgatcgccatgacgtataagttaatccttaatggtaaaacattgaaaggcgagacaactactgaagctgttgatgctgctactgcagaaaaagtcttcaaacaatacgctaacgacaacggtgttgacggtgaatggacttacgacgatgcgacgaaaacctttacggtcaccgaaaaaccagaagtgatcgatgcgtctgaattaacaccagccgtgacaacttacaaacttgttattaatggtaaaacattgaaaggcgaaacaactactgaggctgttgatgctgctactgcagagaaggtgttcaaacaatatgcgaatgacaacggtgttgacggtgagtggacttacgacgatgcgactaagacctttacagttactgaaaaaccagaagtgatcgatgcgtctgagttaacaccagccgtgacaacttacaaacttgttattaatggtaaaacattgaaaggcgaaacaactactaaagcagtagacgcagaaactgcggagaaggccttcaaacaatacgctaacgacaacggtgttgatggtgtttggacttatgatgatgccacaaaaacctttacggtaactgaggttcatcatcaccatcaccactaa

SEQ ID NO: 2577 - DNA, 1560 bp, Artificial sequence
  Synthetic
atgaactccttctccacaagcgccttcggtccagttgccttctccctgggtctgctcctggtgttgcctgctgccttccctgctccgcgggcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctcgagatttccggcgagccaaccactgaggatctgtactttcagagcgataacgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggggctcgagcggcgtgaccggctaccggctgttcgaggagattctgtaa

SEQ ID NO: 2578 - DNA, 1560 bp, Artificial sequence
  Synthetic
atgaactccttctccacaagcgccttcggtccagttgccttctccctgggtctgctcctggtgttgcctgctgccttccctgctccgcgggcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctcgagatttccggcgagccaaccactgaggatctgtactttcagagcgataacgtgaccggctaccggctgttcgaggagattctgggctcgagcggcgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtaa

SEQ ID NO: 2579 - DNA, 1590 bp, Artificial sequence
  Synthetic
atgaactccttctccacaagcgccttcggtccagttgccttctccctgggtctgctcctggtgttgcctgctgccttccctgctccgcgggcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctcgagatttccggcgagccaaccactgaggatctgtactttcagagcgataacgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggggctcgagcggcgtgaccggctaccggctgttcgaggagattctgggcagcgactacaaggacgatgacgacaagtaa

We claim:

1. A polypeptide comprising:
an N-terminal segment of a protein of interest, a C-terminal segment of a protein of interest, and an internal tag between the N-terminal and C-terminal segments, wherein the internal tag comprises an amino acid sequence having less than 100% and greater than 45% sequence identity with SEQ ID NO: 2 inserted within a protein of interest; wherein a detectable bioluminescent signal is produced in the presence of a coelenterazine substrate when the internal tag contacts a polypeptide consisting of SEQ ID NO: 440 and wherein the polypeptide is not a naturally occurring polypeptide.

2. The polypeptide of claim 1, wherein the N-terminal segment and the C-terminal segment are each at least 20 amino acids in length.

3. The polypeptide of claim 1, wherein the amino acid sequence of the internal tag is selected from the peptides of Table 1.

4. The polypeptide of claim 1, wherein the N-terminal segment and the C-terminal segment, if directly linked in the absence of the internal tag, comprise the sequence of a first protein of interest.

5. A nucleic acid comprising a sequence coding for a polypeptide of claim 1.

6. A bioluminescent complex comprising:
(i) the polypeptide of claim 1; and
(ii) a second polypeptide comprising a complement polypeptide having less than 100% and greater than 45% sequence identity with SEQ ID NO: 440.

7. The bioluminescent complex of claim 6, wherein the internal tag and the complement polypeptide have low affinity for each other.

8. The bioluminescent complex of claim 7, wherein the second polypeptide is a fusion of the complement polypeptide and a second protein of interest.

9. The bioluminescent complex of claim 8, wherein the fusion is an internal fusion or a traditional fusion.

10. The bioluminescent complex of claim 9, wherein the second protein of interest has high affinity for all or a portion of the N-terminal segment and/or the C-terminal segment.

11. The bioluminescent complex of claim 7, wherein the second polypeptide is linked to a molecule of interest.

12. The bioluminescent complex of claim 11, wherein all or a portion of the N-terminal segment and/or the C-terminal segment has high affinity for the molecule of interest.

13. The bioluminescent complex of claim 6, further comprising a coelenterazine substrate.

14. The bioluminescent complex of claim 6, wherein the internal tag and the complement polypeptide have high affinity for each other.

15. The bioluminescent complex of claim 6, wherein the second polypeptide is not a fusion polypeptide or linked to a molecule of interest.

16. The bioluminescent complex of claim 6, wherein the amino acid sequence of the complement polypeptide is selected from the polypeptides of Table 2.

* * * * *